United States Patent 10,724,096 (METHODS AND COMPOSITIONS FOR INHIBITING AND TREATING NEUROLOGICAL CONDITIONS) - sequence listing, part 39

SEQ ID NO: 814 - DNA, 64895 bp, Homo sapiens
actgagactatttctgcacattccagttaatggattaatgtaatgaatgttggtaggtcaaataatgcagctgtgtaaacatttgtttaagctgctgccaacaaagaagtttaatctccctgaaggaaacttcatttttagtcccttcggaaacatctatttacaaataatcaaattgatatacacagtatttctcaatgtacatcccagggcacttgtttatcacagcatgttgtattttgctataggcatttataaataataaaattgctttttaaaaaaataatagaaatcccttcacattctccatagttattcaaagcaaagatagtttttttatatagaaataattgcatgtgatttttcaatttaaagaatgaaattatgtcctttttggtgtcacatcagttaaagggtaggtgatatgactgtctttttgtgtgctgcaaggaggaggaatcagttaagctttgaagactgggaaaaaaggaagagttgaggatggatgaagtatatcactggagagtacttactagaattcatcgactcagacttcattcaataagaaaatatttattgattacctactatgtgttagccgctgtttcagaagcttactgctgaatgatgatgcaagaagattttcacgaaagagattgtggtgaggtagaaagagctctgaacaaaaaataactgattttagttctataaatgccttgggtaacttcttgtcctcgctggtctctatcctgtatgtatgtaaaaagagggtggtgggattgaaccgcatgatctccaattcctatatgtctctgccaccaaagtaccaccagatgactaaaaaaggaaactttgcataggcaatttcaatgtgggaagagtacaatatgttaaggtttaatagacgaacaggccgagaaagctgtgtggctggcataatagagaaggagtgttcatgattctttttgaagggagcgtggtaaactgggtggcagataagtggaagagttctgaggaaattgcagctgagaactggatctatttttccatgtctccatactctcatagatatgggctctagtaaaattgaagccaggctcaatgttagcagcatggtgtaccagaaaaaaaatgttttatgatagtcctgggttggatatttttctgtccaactcgattattagctccctgtggtctccctttcttatttcctatctggatggtgttggaaagtgtctaatccttttagattaaggttgatgcatacattatatgagttaatatatatgacacttaatatatgatactgagtaaattcttgaacgtcaatttgttttcttgctagtataaaagtacaatgatctgggatcttctattagccaaattgtgaatatttgcttaactaaagaattattctctcataaagataatgatgactcttatgtttgccaccttggactggagtatatgttttctttgacaagtatttcacaagtataggcttctaagtgtcatttccctatgccccattaccccttttgccaatgcattatccacctgctgttggagttttctttctaaagcacagttctgatcatgctactcctctgctcaaaattctacattggctccctgttgcttacacaacaaaattccacccctgtgcttgcattctaagctcaccatgattcagattcaccatgtctttccagcctcatctcacatcatatcactgcatgcacattaccctctatttcaggggttctcaaatctaagtgtgcttcagagtcacctggatgtcttgttgaaacacatgtttctgggcgttatgcccagcatttctgattctgtgagtctaagagggagccttgaaattttgcatttctaataagttcccagttgacactgatgttgcttatctagggactacacttttaagaaccactgttggccaggcgcagtggctcacacctgtaatcccagcactttgggaggtcgaggccggggggatcacctgaggtcagaagttcgagaccagcctggccaacatggtgaaaaactgtctctactaaaaatacaaaaaattagctgaatgttgtggcgctcgcctgtaatcccagctactcgggaggctgagtcaggagaattgcttgaactggggaggtggaggctgaagtgagccgagatcatgccactgcactccagactgagcaacacagtgagactccatcaaaaaaaaaaaaaaaaagggagagagattgagaaccattgctctaacaacaccaaatgctggttcttttggaatatatctagtgtctactttttcatcttagcatttttctgatgctctttcctccttccttgggctccttctattggtagaattcctctcatttttaaaactaattttactttcttaggaagctcgtactaatcactcagtcagtattaaagagggagcactgactcttgtttcccttcacaacatgctgcttgtactctgctttagtatttataccattctgcattgtactagagctaattgtgtttgtcctcttgctcacattcagttgtcaagcccatgaaagaagggaccatatttcattaatcttcgatcttcaaacgaactgaatttcatcatggtgcctaaaagccagccccagtaattacacatctgttttctttaaaatgtatctgattattgcagcctgcagaagacaacaatcttatgggtggcagccaccctgccttttgaggtagaaggatatgcaccatttaagtgcctgaacaaatggattccatcagcaacctgatagagaaatttaccaaggttagaaagaaaccagcctgaaatgttggggtggtaggtttcagagctgcctgtataataaagatgctgaaccccattgcagtaagtcaagctgtcacagggaacactatctaaagccaactccaatctaatgaggtgtttgaattattgttaaaaggaagaatgccagaagctatttcttctctgtggattgtgctttcctataccaaatgtacaggaaagaaccaggggaattagtaatgaagccagagtaaatgcacagtctggagaaagttttgttcaatctaaatttcagagaatgtaacataatcaatttccttaaatactctgtcagtttccaaagagcacagagtgaacccaattctcccatatgacaccccgctctctgttagtgggaaaggtgcttgttagcctccctcctactccagtttctctgcccctgctttcctcttgaataccaggtcctcttcccttcttatgcctcatactatacttgggcattccatctgacctgacttcctctgtcatctttttgctgatgaccacgtctttccttgggctccttctattggaggaggatccaatagaaggttccagcctagatcctcctcctgagcctcagatccctggagccaataattttctcttaattctccttggctgttccacagtcatctcagattcagtatctccccaaattaactcatcattttcctggtactttggttatttgtagggtgtctacctcaaagaacaaggagttggtacaaccattttagaaagctgttcaatcatttctactaaagctgaatgaatgcacaggacatgaccccaaaatagccaacagaattgcttacatatattcaccagaagagatgtacaagaatgtttataccacactatttgttatacctcccaactggaaatgatccaaggtgtctctagactgtagaatgggtacatcattgtggcttattcatacaataaaatgccattcatcattaataatgaacaaaccatgtggaacaccatgagtgaaccctacaaacataaggttaaaaaaaagccagaagccagatacagaatatagactgaatacttccgcttgtataaagttcaaaagcaggcagaatgaagctgtgttgtgaaaagtcaggagagagaatacccttggggaagtgtgatgggaaggaaccctgagagcttcggggatactggtaatgttctttttctcaatctggatgctgatttacgtgatggtgttcagtttgggaaaattccttgtatggcacactagagagctgtggacttttctcaatatatatgtcaataaaagttacaaagataagtaaagaacatggatcactgctctccgtctctttcagctgctgagagttcagccttcagtcctggttctgtcattttcttatgctgggtaactttcctatgtggctatgagggcccttggtggccctcatccccagtagaatgagaagacatatgtgtgagggcacagtatgtaaggtttagtcagagtgatgtttctaaccatctggttagctgttcaggcctccatggctttctacgcccaaggtgggtccccatgaacactggcctcagtctaaaactcagcctgagaagagactgcatgttgaaactctgtagtatgagtcacttgtggacatagattccctatgtaggaagctaaacaggtgtttggtgtgtgaatcaattttatagtctccaaataaatggaatttaagagctgctgttggctagaaacccagatttgtatcgcaagtgggatagagtccattatcagctgagttgcagcattcgtcttttagttagcagataaactctggaatctctgtggctaaaagataaaacctgaaatctcagagtattaactcagtagaagtttatttctagcttttgttaagtctaacagcagcagtgttggggagatggggctggggagagaagaatccacaccatgcagccgttcaggctttcagaagctttggtgtcttcaacatgtggcttccaaggacactttggacactgacatccagctggcacagaggaaaataagagtggaggactgtgcagtaagttttcacagtcaggcctggcaacagcatctctcatgtctttccagtttttattggctagaatctggtcatatcactgcatctaacagcaagggagtctaggaagtatggcccagctgtgggcatggaagaaaggaaaacaaatttgatgactagctagccagtgtctgccacatttagatttacctacaagcagagaaaaactacatagtattgaaggtggatgtcgaaagcaaatgtgatcctctgttgggtggaatatatcacagatgtggcactaggaagtaagatttcctgcctgatgagctgaggggagacatccaaaataaaactgtgcccttattgcaattcagagataattttttgttcttttggtgctacaagctgaaaatggaacactgagaaaatgtgtgagcattccatggtgagtaaacagaagaggaagactgactttcctaattagtgtcctcccactgcaacttttttcttctacattgtctcacattcacacagtcacctaagcctcacattgagagaagttcttccatcttcatatttatccatatatttactatgacctgccaagttcgtgccctacattgtattcactccattgcatcagtgcatttctactgatgctcttccaattctggaaatctagttctcaagtgggctactgccatatgtctatcagatcttcccacttaccatctctttcctttgatctagtctccacgcattgtcaaaatcatcttaaagtaacgttgttcaagcattccagtgactccccattgcctgtaaaattaaatataaactcctttgtttgacgtatacagcattactcaatctagactcaaaatgcactgttcacctttatctctggaaattgaacaaccctaccaattctgtattccagcctaccctaactccttgtcatactctgtacaatctcaagtccatttcacaggcttccaagcatgccttttctgggcttcacctggtgagtccctaatcattaataaaacctaactcaaatgtcacctctttcttgagacttccaaagctccttcagggagagttaattccagtaagacttatcttggttatagcactcatcacattgcattgtattttcttgttatccacctctcctgctatattgtcctggaaggcaatgtagtgtgggggaaaaaagacagaatttagaagtcagattagacctagatttgatttctaccatttcacatgactacctatgtagctttaagttacctaagctctctaaactacaggatcctcttctgtgaaatggggatggtaatatttcatatgatatgtatacaatgtcttatacaggacaagaaaccacatgcctaatttatttattattccccagtattctcctcctctttcttgtattttgtcttatataaaaggctatctttcagtaaaggcatacaataaaggttttctaaatgaatgaactagaaagttagcatcttgggactatctagtgcttacctccatcacagctctccctttttttttttttttaattatactttaagttttagggtatatgtgcacattgtgcaggttagttacatatgtatacatgtgccatgctggtgcgctgcacccactaactcgtcatctagcattaggtatatctcccaatgctacccctcccccctccccccaccccaccacagtccccagagtgtgatattccccttcctgggtccatgtgatctcattgttcagttcccacctatgagtgagaatatgcggtgtttggttttttgttcttgcgatagtttactgagaatgatgatttccaatttcatccatgtccctaaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctccttgtggttttgatttgcatttctctgatggccagtgatgatgagcattttttcatgtgttttttggctgcataaatgtcttcttttgagaagtgtttgttcatgtccttcgcccactttttgatggggttgtttgtttttttcttgtaaatctgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacaggaagtccttgcccatgcctatgtcctgaatggtaatgcctaggttttcttctagggtttttatggttttaggtctaacatttaagtctttaatccatcttgaattaatttttgtataaggtgtaaggaagggatcctgatgcagatcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccctatagtatagtttgaagtcaggtagcgtgatgcctccagctttgttcttcgggcttagaattgacttggcaatgtgggctcttttttgattccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttgggttcctaggtattttattctctttgaagcaattgtgaatgggagttcactcatgatttggctctctgtttgtctgttattgttgtataagaatgcttgtgatttttgcacattgattttgtatcctgagactttgctgaagttgcttatcagcttaaggagattttgggctgagatgatggggttttctaaatatgcaatcatgtcatctgcaaacagggacaatttgacttcctcttttcctaattgaataccctttatttccttctcctgcctgattgccctggccagaacttccaacactatgttgaataggagtggtgagaaagggcatccctgtcttgtgccagttttcaaagggaatgcttccagtttttgcccattcagtatgatattggctgtgggtttgtcatagatatgtcccatcaatacctaatttattgagagtttttagcatgaaggttgttgaattttgtcaaaggccttttctgtatctattgagataatcatgtggtttttgtctttggttctgtttatatgctggattgcgtttattgatttgcgtatgttgaaccagccttgcatcccagggatgaagcccacttgatcatggtggataagcgttttgatgtgctgctggattcggtttgccagtattttattgaggattttttcattgatgttcattagggatattggtctaaaattctcttttagaccaatttttgttgtgtctctgccaggctttggtgtcaggatgattctggcttcataaaatgagttagggaggattccctctttttctattgattggaatagtttcagaaggaatggtaccagttcctccttgtacctctgatagaattcggctgtgaatccatctggtcctggactctttttggttggtaaactattgattatcgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatgggtggtgatatcccctttatcattttttattgtgtctatttgattcttctctctttttttctttattagtcttgctagcagtctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttcccttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtcaattaggtccgcttggtgcagagctgagttcaattcctgggtattcttgtcgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttttttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctcttatttaagaatgttgaatattggcccccactctcttctggcttgtagggtttctgccgagagatccgctgtttgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttgggctgccttgctagattggggaagttctcctggataatatcctgcagagtgttttccaacttggttccattctccccatcactttcaggtacaccaatgagacgtagatttggtcttttcacatagtcccatacttcttggaggctttgctcatttctttttattcttttttctctaaacttcccttctcgcttcatttcattcacttcatcttccattgctgataccctttcttccagttgatcgcatcggctcctgaggcttctgcattcttcacttagttctcgagccttggttttcagctccatcagctcctttaagcacttctctatattggttattctagttatacattcttctaaattttttccaaagttttcaacttctttgcctttgatttgaatgtcgtcccttagctcagagtaatttgatcgtctgaagccttcttctctcagctcgtcaaagtcattctccatccagctttgttccgttgctggtgaggaactgcgttcctttggaggaggagaggcactctgcgttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacctgaggaggcagtctgcccgttctcagatctccagctgtgtgctgggagaaccactgctctcttcaaagctgtcagacagggacatttaagtctgcagaggttactgctgtctttttgttggcctgtgccctgcccccagaggtggagcctacagaggcaggcaggcctccttgagctgtggtgggctccacccagttcgagcttccctgctgctttgtttacctaagcaagcccgggcaatggcgggcgcccctcccccagcctcgctgccaccttgcagtttgatctcagactgctgtgctagcaatctgcgagactccgtgggcgtaggaccctctgagccaggtgcaggatataatctcgtggtgcgccgttttttaagccggtcagaaaagcgcaatattcgggagggagtgacctgattttccaggtgcgtccgtcacccctttctttgactcggaaagggaactccctgaccccttgtgcttcccaagtgaggcaatgcctcgccctgcttcggctcgcgcacagtgcgcgcactcactgacctgcgcccactgtctggcactccctagtgagatgaacccggtacctcagatggaaatgcagaaatcacccgtcttctgctttgctcacgctgggagctgtagaccggagctgttcctattcggccatcttggctcctcccccagctctcccttactgctacccttttgcaagtggggaaaggctctcaaggtagttatccataatgatttcatctagaaaatgttcgtttatgcttttcttttgacaatggcaaagttttcatcaaggatagttaaaatcagaagatctgttttctttttcttattttttaacaaaatgacattatttttcttatctgtttttattttacgtttggggatatatatgcaggtttgttacataggtaaattgcgtgtcactgaggcttggtgtacaaatgatcccattacccaggcagtgagcatagcacctgataggtagccttccaacccacaaatccgcctcccaccctccctcctcaagcagtccccagtgtctattgttcttatctttgtgtccatgtgtattcgatatttagctgttacttataagtgagaatgtgcggtatttggttttctgttcctatattagttcacttaaaatgagggcctccagctgcatccctgttgctgcgaagggcatgatttcattctttttatggctgcatagtattccatggtgtatatgtataccagtccaccattgatgaacatttttatttatctagtccactgttaatgagcataatagttgattctgtcttttctattgtgaatagtgctgtaagaaacaagtaaacgcatgtgacttttcagtataacaacttattttcctttgagtatatacccagtagtgggattgctgggtcaaatggcagctatgttttaagttctttaagaaatgtccacactgctttccacagtggctgaattaatttacattcccactagcagtgtagaactgttaaattttctctgcagggtcaccaatatctgttgttttttgacttttaaataatagccattctgacttttatgaaatagtattgcattgtggttttgatttcattttactaatgatttgtgatgatgaactttttttcatgtatttgctggctgcacatatatcttcttttgagaatagtctgttcatatctgttgcccagttccttaaatgggtttttttcttgttaatttgtttaagtgacttatagattctcagtattagatctttttcagatgcatagcttgtatttttgctcattctgtagattgtctgttcactctactgaaagttgcttttgctgtgcagaagttctttagtttagttaggtcccatgtgtcaatttttatttttgttgcagttgcttttgaggacttagtcataaattctttgccaaggctgatgtccagaatggtatttcctaggttttcttctagagtttttagttttaggttttacatttaagtctttaatccatcttaagttaatttttgtatgtggtgaaagaaaggagtccagtttcaatcttctgcatatggctagtcagttatcccagcataatttattgaacagggagtctttccccattatttgttattgttgacttgttgatgttttcttttgttgttgtgtctctgccagatttcagtatcagaatgatgctggcttcatggaatgagttaggaaggagtccctcctccttgattttttttggaataaattcagtacgattggcactagctcttctttacatctggtggaattcaactgtgaatctgtctggtccagggctttttttgattggtaggctttttatcactgattcaattttgaaactcattattgatctgctcaggatttcaattttctcaatcttgggaggctgtatgtttccaggaatttattcatttcttccagattttctagtttgtgtgcatagaggtgtttgtaatagtctctgagaactttgttttttgtttcttttgtttttgtttttgttttgtatttctgtgggattggttgtaatgttgccattgtcgtttcttattgtgtttattaggatcatctctctttttaaatttattattctagatagcagtctagattaacagcagtctatcaatcttatttaatcttttaaagagccaacttttggttttgttgatcttttgtatgaatatttgcatctcaatttcattcagttcagctttgattttggttgtctcttttcttctactagctttggggttggtttgctcttgtttttctaggtgtaacattaggttgttaatttgagatctttctaccttcttgatgtacgtgtttagcagtataaactttactcttaacactgctttagctgtatcctaaaaattcttacatgttttacctttgttttcattagtttaaaagaagtttttgatttctgccttaattttgttctttacccaaaagtcattcaggagcaggttgtttaacttccatgtaattttatcattttgatagatcttcttgatattgatttctatttttattgtgctgtggtctgagagtgtgcttggtatgattttgactttttaaaatctgttgagacttgctttatggatgagcatgcagtcagtcttagagtatgtgccatgtgcagataagaagaatgtatgttttgttgttgttgagtgtagtgttctgtagacctctattaggtccaattggtatagtgttgaggttaagtccacaatacttcgttagttttctgcctcagtgatatgtctaatgctgtcagtggagtgttaaagtcccctaccattattgtgtggttgtctaaatctcttcatagatctgtaagaactggttttatgaatctgggtgctccaatgttgggtgcatatttctttaggatagctaagtcttcttgttgaagcttaaatcattatgtaatgcccttctttgtcttttttgatcattgtttgtttaaagtctattttatctgatgttagaatagcaactgctgctctttttttggttttgttttctgtttgcctgatagctctttctccatttctttattttgagtctatgtgtgttattacttgtgagacaggtctcttgaagacagcagacagctgggtcttgattctttatccaactttctactatattccttttaagtggggtatttagcccatttacattcagggtcaatattcatatgtggggactcaatcctgtaatcatgctgttagctggttgttatgtaaacttgattgtatagtttctttatagtgtcaaagggctatgtacttaagtgtgtttttgtggtggcaagtattgttctttcatttccatgtttagcactcactttaggaccttcttaaggcaggcccagtggtaagaaattcccttagcattttcttgtctgaaaataatttcatttcttcttcacttataaaacttagtttggcaggatatgaaattcttggttggaatttattttctttaaggctgttgaaaataggcccacaatctcttctggcttgtggaatttcagctgaaaggtccacagttagccttatggagttccctttgtaaatgacctgcctcttctcactagctgcctttaacattttttctttcacattggccttggagaatctgacacctgtgtgtctaggggatggttgtcttgcatagtaactcctaggattctctgaatttcttaaatttgcatgttgacattgctagtgggattgggaaaattttagtggattgtatgctcagatacgttttctaagttgcctgatctctctcctcttgtaggaatgccaatgagttgtaggtttggtctctttacataatccattatttctcagagattttgctaattttttaaaattcttttttctttacttttatatgcctatattgcttcaaaggaacagaactcaagctctgagatactttcctcagcttattttgttgttaatgattccagttgtattttgaaattacatagtgaacttttcattttcagaagttcagtttagtctcatcttaaaatggaatgtcttctctagatagttttactatttccttgaattggattttaactttctcttgtattgcaatgagcttccttgacatccagattctgaattccatgtctgacatttcagccatttaaatctggctaagaactatagatggggagctagtgtgatctttaaagatcacactactacctttaaagttaagaagacactttgacttttagagttgccagaattcttgagctggttctttctatccatgagggctgatgttcttttatcctttttagttgctgtcctttggatggggctttttgtttctatgttctatattgcccttgaaggtttcaatgtggtgcaaattgggtatagttgaatggctttgtttctggatactttcatatggctaaggctcagtactccacttctgggctatgtgctctaaccctgggtggctgggactgggcccatagctttgtcctcttgtctctcaaaattgagccttggttgggctggaggagccaaggtatacttctagaccactgaaaacagtactctgttggtggtggtaggggcagtgggcgtgctaagggtgggaagcactctagtgggggtgcaatggggaaacactttcccaagggggcaatggcagtgtctcaagcaaatgtgctctggcagaaggtggtagcaaaagtgctctggcagggtcagcaggggctccacagcaggaagtgctgtggtatgggcagcttgggtgctgtgtgtagggaacactctggtagtgtattagtccattttcatactgctatgaagaaataccagaaactgggtaatgtttgaagaaaaagaggtttaatggactcagagttccatatgactggtgaggcctcacagtcatggcagaagatgaaggaggggcaaaatatgtcttacatggcagcaggcaagaaaccatgtgcaggagaactgctttttataaaaccatcagatctcataagacttcttcactatcatgagaacagcatgggaaaaacccatccccatgattcaattccctcccaccaggtccctcccatgacacatggggattatgggagctacaattcaagatgagatttgggtggggacacagccaagccgtattattccaccccggtccctcccaaatctcatatcctcacacttcaaaaccaatcctgccttcccaacagtcccccaaaatcttaactcgtttcagcattaactgaaaagtccacagtccaaagtcttatctgagacaaggcaaatccctttcacctataagcttgtaaaattaaaagcaagttagttacttccaaggtacaatggggtacaggcattgggtaaatacacccattccaaatggggaaaattggcaaaaatgaagaagctacaggccccatgcaagtccaaaatccagcagggcagtcaaatcttaaagctctaaaatgattgcctttggcaccacatcttgcgtctaggtcatgctgatgcaaaagatgggctcccatggctttgagaagctctggccctgtggctttgcagggtagagcccccttcctggcagctctcatgggctgaaattgagtgtctgcagctttttcacgggcatggtgcaagatgtcaggaaatctaccattctggggtctggagcatgatggccctcttctcacagctccacaaaggcagtgccccagtgaggattctgcgtgggggtcccaaccctacatttcctttctccatttccccagcagaggtttgctatgagggccccacccctgaagcaaacttctgcctggacatccaggcatttccatatatactctgaaatctatacggaggtttccaaacctcaattcttgaccttctgtgcaagtggaagctaccaaggcctagggctttcaccctttgaagccatggcccaagctgtaccttggtcccttttagccatggctggagtggctcagaggcagggcaccaagtccctaggctgcacacagcaggggaccctggatctggcccaggaaacaattttccctccttggcctccaggcctgtgatgggaggggctgctgtgagatctctgacatggcctggagacattttttccattgtttttgtgattaacaattggctccttgttacttatgcaaatttctgcagcaggcttgaatttctcccccagaaaacgggtttttattttctattgcatcgtcaggctgcaaatttttcaaacctttatgctctcctttctcttgaatgctttgccgcttagaaatttcttctgccagataccctaaatcatctctctcaagttaaaagtttcacagatctctagggcaggagcaaaatgccaccagtctctttgctaaagcataacaagaatcacctttgcttcagttcccaatgagtccctcatcttcttctgagaccacctcagcctgcatttcattgtccatatcactatcagcattttagtcaaagccattcaataagtctctaggaagttccaaacttccccacatttttctgtgttctgagctctccaagtctctaggaagttccaaacttttccacattttgttaccttcttctgagccctccaaatggttcccatctttgcttgttacccagttccaaagctgcttccacattttcaggtatcttaatagcagtactccactctactggtaccaatttactgtattagtccattttcatgagctatgaagaaacatccaatactgggtaatttataaagaaaaagaggcttaatggactcagttccacatggctggggaggcctcacaatcatggtggaaggcaaaggaggagcaaaggcacatcttacatggcggcaggcaagacagtacatgcaggggacctgctgtgctcctctgcagccatccccacacagcccacctaggctttatgcagattcaggttgtctctgactactctccaggcagttcgccctgcccactaagatgtccatgtggttttggggcttcctgcagctataatcccagaggtcagtggcaagagtgggcagctccacatttatttcactactcccctttttcttagcagtcatttagggcctagagcatgtcctagcacttgacaactctgtgcaggtttcctagcttcctcttggttaagccctagcatctgggttatctctttagccattctcattgcattctctcagatgatctgtttggagtatggcagtctacttgatattctggcttgtcctggtgggaggagttcttggctacttctagttgaccatcttgtctccctccctattttcctgattattttagttttacaggtcttaaaaccaagaactataaattctctgtgttctttttatttcagagttgtgttacctgttttggtttttttgtttcatataaattatttaatcaaatcatcaatttctccaaaaaggcctgcagaattttgatagggattgcattgaacatgtagcccagtttacagagactgcatatcttaacaatattgagtcttttaattgataaacattattcatttatttcagtcttcttttgtttttctcagcaatatattgtagttttcagtaaaaagtgcttgtatatttttagttagttttagttcaagtttttgaagtttttacaacctgttgttaattgtattttttagttttgatttccagttgtttagtgtttaggctttttaacctgtaacttttctaaatttacttattaattttgttaatagatatgttattttatgtttttatttttgtgatttaataaaaatatattgtcaaggattttcccttttatctaagttactgaatttatttgcataagattatttgtttctttattactttttaaaaacttttatatatgaccatagtacatttctcgaaattaggaaattaacattggtatgatactattaattaaagacattcagatgtcaccagatgacttctgacatttcagatgacattcaatttttgtattaatgtcttttttttttctgttccaggaatcaatgtagaatactacctacatttaattgttttgcttttcaatcctctctaatctgtgatgctttctcagtctttccttgtttttcatgtctttgatagtttttatattttttattgatttacatttaattgacaaacaataattgtgtatatttatggggtacattgtgatgttttgatctacatatacattgtagaaagattcaatcaatctaattaacatatctgttacttcaccaagtttttttgtggtgaggacattaaaaatctattcttttagcaattttgaaatatacaatacattattactaactgtggtcaaaatacagtaaaataaataatccaaacttacttctccgatttaactgaaagttagtaccctttgatcaacatttcccctttttccactccttcccttcccctccagcctctggtaaccacctttctttctttctttttttttttattgttgttgtttactgaccttcttttggatagatggtggggagaaggtcagagaaaccttcctgcacaggctgtttttcaaataccttcagtttaaaatatttaatatatcaagtttcaatgtttttggtagtatgtttttgaaccccatcagttagatacttacatagagtgtctaagttattacattaatgtaacaggagtggggttccatggctattcagatgaggtaggacatctggttctgtctagcttcaccatgatcagatgtgtgaggggtgggtctcccttccaggctacaactcccagccaggtttccaggacccccccttcacctcatgttcagggctggtgaatggagagattgcctccatgagggggtcagatgggggtgctaagcaatgtgttgatggagagatgactgtcattcctgctgacaattcaaggcaacaaacaggctgctcactggaccatagagagaagggcaactggacactgatttgctgcttgtgcctgtggtggatggagacctcttgtccttactctactcctttctagatggttgtggtatcttttattcagtctaagggcaggaaagccttgctctgcaagtttatatctgagcctctgtgtcatgttatgcttagaagtggacattgaaggctaactgtttgggttaaaggagaaaaccatcagagactgaaggatcatggactcagaagtggggaagaccataaaggaatgcttttaattaccatcttactgcattaaattaatattgatctctgtgccatacttttacttcctgtgtctggtttctgtgaggattatctgcaacccaagagcataaaccattattattattgttattatttttaaattttcttttttttaaattttactttaagttctgggatacacatgcagaacatgcaggtttgttacataggtatacatgtgccatggtggtttgctgcacctatcaacctgtcatctaggttttaagtctctcatgcattaggtatttgtcctaatgctctcccttcccatgccccaccccctcccgccgacaggccctggtgtgtgatgttcccctccctgtttccatgtgttctagttgttcaactcccacttatgagtgagaacatgtggtgtttgattttctgttcctgtgttagtttgccgagaatgatggcttccagcttcatccatgtccctgcaaaggacatgaactcattcttttttattgctgcctagtatcccatgtgtatatatgccacattttctttatccactctatcatttatgggcatttgggttggttccaagtctttgttgttgtaaattgtgctgccataaacatacatgtgcatatgtctttgtagtagagttggtaaccacttttctattcggtttctgtgagatcatcccttttagattccacatataagtgagattatacaagtacataaaggtaacaagatttttatcccatgcttttcttgatgtttattagttttgggttctaattttgttcttagatccatgtttgaattaatttttgcatatagtgtggggtatagatcaaagacctttatttgtgtatgtatggaaagccaatattttcaacacccattttttgaaaagtgtaccctttcttcacttaattgcctttgggtcttcgtcagaaatcagctgtctatatatgtgtgggttaactactgaagcctattctgttctactgatctgcttgtctatctttaagccagtgaattactcttgatcactataggtttataataagtcatgaaattaggtagtcttagccttcctgttgtgttcttttgccaatattttgactattctatgtcttttgaatttccatatgaattttagaatcagcttgtcactttctatagaaaagcctccttgaattttagttgggacttaattaaatctaaggttagttagggagaattaacaatttaaatatattgttttctgcttcaaaatatcctttaactgattttagtatagccacttcagccttcttttgattagtatttgtagggtttatttgttcaacatttcattttttaaatattttagtcattatttgttttttaaatggatacataacatttgtacatatctgtgagttgcatatgatattttattagatacatagacaatgtaatgattatggctggctatttgtggtcttcattattttaagtatttatcatttttatgtcttgggaacattttgagtcctctcttcttgccatttgaagtatacaatatattgttgttaactatagccaccttactctgccatcaaacattagaacttattccttctatctaactgtatgtgtgtacccattaaccaacctctttttatcacccccctttccccacccacacacccttctcaatctctggtatccatcattctactctgtacttccatgagattacctttttagcttttatagatgagtgaggacatgtgatatttgtctttctgtgcctagcttttttcgcttaatagaatgacttccagttccatcctcgtttctgtaaatgacataatttcattcttttttatgcctgaatagtatttcatcatgtatatataccacattttctttattaattcatttgttgatggacacttgggttgaatctatatcttctttaattgtgaatagtgctgcaataaatatgaaagtgcgggtatcactttgatatacttatttcttttcctttgagtaactattcagtgggggattgctggattacatgatagttctatttttaggtttttgagaaatctccatactgttttccatagtggttgtactattttttttttttttttttttttttttttttgagacagagtctcactctgtccctcaggctggagtgcagtggtgtgatcatggctcactgttgccttgacctccctggacttaaacaatcctgctgcctcagcttcccaagcagctggggctacaggtgcctgtcaccacacctggcaattttttttttttttttttttttttttttgtagagacagggtttcactatgttgcccaggctgacctcaaactcctgggcttgaggaatgtgcctgccttggcctcccatagtgctgggattacaggagtgagccactgggaccagtctgttgtctttttaataatagcctttctagctggggtaagatgatatctcattgtggttttgatttgcatttccatgatgattgattagtgatttttttcatatacctgttggccatttgtatgtcttcttttgagaaatgtctattcatgtcctttgcctactttatagtgagattattattactttttttactcttgagttatttgagttccttgtatagtctgaatattagtcacttgttggataaatagactgcctatattttctcccatttaacaggtggtctcttcattctgtcgatcgcttcctttactatgcagaagcttttaactttaatatggttccttttgtctatttttgtttttcttgcctgtgcttttgaggtcttagccataaaatctttgccaagaccaatgtcctaaagtgtttccccagagggaaaaaatgatgaagttcagagcagaactaaacaaaatagagactaaaaaattttataaagaacaacaaaacaaaaagttttttttaaataagataaacaaaattgaaaactattagctacactaaccaagaaaaaaagagaagacccaaataaacaaaatcagaaatgagaaagaagatattacgataggacagaaatacaaaagatcatcagagactactatgaaattatccctctgcagatgatatgatcttatatctagaaaaacctaaagattctactgttaaaatgattgtactgcctgggcacagtggctcacgcctgtaatcccaacactttgggaggtcaaagcgggtggatcatgaggttgggagttcaagatcagcctggccaagatggtgaaaccccgtctctactaaaaatataaaaattagctgagcatggtggcgggcacctgtaatcccagctactcggaaggctgaggcagggaattgcttgaacccaggaggcacaggttgcaatgagcagagatcgtgccactgcaccacagcctgggcgacagagcaagactctgtctcagaaaaaaaaaaaaaaagaaaagaaaaaaagattatactgcccaaaacaatatacagattcagtgcaatccctatcaaaatacaaatatcatttttcagaaaaataaaaaaaattctaaaacttacatggaaacatgaaagcatcctaatagcccaatcatgaacaaaaagaataaagcaggaagcattacactacttgacttcaaaatatattataaggctatagtaaaccaaacagcatggtattggtataaaaataggcatatagaccaaaggaatataatagagaactgagaaataaatccatgtatttactgtcaactgatttttgacaaaggcactaagaacatacacagggagaaaggacacactcttcagtaaatggtgctgggtaaattggatgttcttatgcaggagaatgaaacttggtctttaccttttaccatatataaaatcaactcaatttggattaaatatttaaatgtgagtcattatatttagaatgtgtttcttgttagcagcatatacttaggtcttgcctttttatttaatctgccaattaattaagggcatttagcacataaagatgaaaggtgattattgatatgattggagttaaatttatcatcagtctatctgtttttcaaaacatctattccctctgttacttgtttacctttcctgtttttctatctttgggataattgaacatactctatgattccattttaattttccttgttgtgctatttgctatggtttgtccctttctttcctccttcccttccctcttttctctttttctttgtctttctttttctgtccctccctccctcctccctctctccctctctgcactttttccttccttcctttcttttttttcctttctttcttttccttctcctctctccctccccttgccacccctctctctctctttcttttcttttctttgggactcatatatcttgtaccattatcagatgtcatacctctttgggtatagcacaagatccttacaaagatgtcttttcatcccttcctcctgatcgtcgtgttattgttgttattcattttaattttagataaatctcactctacatagtgattacttttaatattcagctatgtttaacagagttacagaaattacaaaaaattttgcatttactcacattttgggcatttctagtacccttcatttctttgtatgggtgtagatttctatttggtattatttttcttctttctgtactttagatttgctactgatgagctcttaactatttgtatttctaaaaacagccctagtttgctttcattttaaaatgtacttttacttgatatagaattaatagttgataggtttttttttttttttagtattttagagttggttcactatcttctgtattacattgttcctaatgagaagtctgcatcaattttatttttcgttctctgtacctagtgtgtcttttgtctttggcagctttcaagacttatcactggttctaagtaatttgatttttatatgccttggtgtagtgttttttcatatttcttttgcttagtattcattgagcttcttgggtctatgactttatagttttcatgaagtttggatacaactttgtctttttttattatactttaagttctagggtacacgtgtgcaacttgcaggtttgttacatatgtatacatgtgccatgttggtgggccgcacccattaactcgtcatttacattaggtatatctcctaatgctatccctccccccttcccccaccccacaacaggccctggtgtgtgatgttccccttcctgtgtccaagtgttctcattgttcaattcccacctatgagtgagaacattcagtgttagattttttgtccttgcgatagtttgctgagaatgatggtttccagcttcatccatgtccctacaaaggacatgaactcatctttttctattgctgcatagtattccatggtgtatatgtgccactgtttttatctgctcttaccactctagaggacttcaattacaagtatattcagctacttaaaattgtctcacaactcactgatgacccgttctttttttgttttgaatgttttctctctgatttatatgcataatttctactgctgtcttcaactttgatcatgctttcttcttctacaaggtctattctgctgttaattctggtcaatgtatttttcatttcagctattttatttttcatctctcgtcgtttgtgtcttaaaaacattctctcatgtctctacttgcttgtttttgctctacatgctaatgtttcctctactttctataaatatggaatacatttataattacctttttagagctaatcacacaaatatttattagtactataatactgtcaccttcttaatttagagaagaaaaattgggatctggcttggaagttctactccaaggtatctggcgtccccagcttttctgtctttcttctacattctccaaccctgtgccctgtgcttctaattcatatttagcagtgactgtgttactatactcttaacacttccagagttgggttaaaaattgaatgcatgcttgaaatttatttattagtctaagtatcaatgaccataacatttgactagccacattacagatgtgaaattggtctgcagtttataatactgaatcttatttgtcttgccattttcacatctgagtattaactatgggtgatttaattgggtttgggccatagtcctaaaagattcaattcctaatgctataatcatgaatgttgaactcctgaaagatccaaattcctaatgtctaaaatctaaaaatcataatcttgaaaaatcaatatccctaaaatataattctgaaaaagactaatttaaaaaatactttgaaaaacattcgtttacacttttaaaggggatttatttgacaaacatataaaacatggcagaatacttcataggacactttacacaattaaatagataataattacacatttttgcaagcataggcactccagtatactaacaacagtcacacagttttgaacataaaacttattgataaagaaatgggtcaaaatgggaaatgtataggcatatatcactatcattggtaattgtgtgcatccagctttgtacctgcagtgatctgaaatactataaaggacaacctaaatgttttgatgagactgataaaaaactgcaatgggtcactatcacatattcagttacctgaagagctgagacctggagaaattttatctttcatatatgtagagatacaaaaaggatatctcttcatttattgaggaagcttcaacatttttatgtatatgtataatgcttgcacacaaagtcagtattgtgataatgtatttttatggagtcaaatttgcaaagaatgcataaaacaaattagaattctctaaaagtcttaaatttatctgtacctccagtattggaaatgatataaagataaaatacaacacatagcaaattgtaaaaaataatgctgacaatttaaaacagtggggaaaataaaactaaaagaaaaacctaaaagaaaatttgatacatgaataaaagatgtattacagggatagattatggacaaccgtatggagatagtccataagagctggccaactttcatgatcatttactatattttgacatcttgcatagtaatgaatagctgtgttgttgtttttttttcttttagggcatggctttcctcagggaatatgttcacactcattttctatgtggtgttgatctttttgaaattctgctatgatttaatatattgtgacatgaacattccctatcaaaattttgcatcttctctgccttgttttcatgttgttttacttatgcaaaaatccatttcacatgcactaaaatacaaaccgtaaatttagaggaaacaatactggtgatggaacagcaacaccatttagtgtcttcttactttaccatgcatgtaaccatttttgaactagtcagtaactgccttggcttctccaggcaaatgtggctttaattcaccaaaagctcctagaatatcatcagctagaaggaatgccagtgcagaaaaatgacacatttttaaacttgaagtttttgttattgctctattgcatggccaatccactcatctgaattttctgtcaaatgcattggactgaatggataaaacaaattttgttagtaacaccttgaaatttattttagaggtcttgatcacactcagttccaaatctgtcattatggtttggggattcagttagacgttatgtattttagactttagggattttgatctttatggatgacttttgatcttttgggatttcaacatttggattatggcatttgggattctgattttcagaattatgattggcaattttaactaattctggctcggtatattaataatgcaatgcttttttcaagctatttgtaagtgattcatcttccagtctaatgtgaattctagaaggaaggcaactcgcttgaaaagccacatggttcaagaactcaaattgggaatgattttttaaaaaaacttgagacaaatttcacttactagaaaatttaccttcttaaagtataaaattcaatggttttcagtatttttgcatgaaggttccagtttctctacacctctgattgttatttgccttccttcctccctcatttattataatcattttagtgggtgtaaagtggttccgattgtagttttgatatgcatttccttaatgactaatgatgttgaacgtcttttttcatgtgcttattggacatttgtaaatctcctttggagagatgtctattcaaatccttaactcattttgtaattgggtcattgtttctacactagcttttaaaatgttcttgtcaactaattctattacatatgttatttcaaggtatttttcaattgattgacttttcccacctttatggattgtagtgtcttgcttctttgaatgtctagcaattttatattgaatgtcaaacatggtgaatttgaccttgttgggtgctgggcattcattagtttaaagaataatcttgcattttgttctgtaatgtacttgttatttggcaacatttaatccttcaagtcatgcttttaagtttcattagtctgggccagggcagccttcagtttagggccaattttgttccactactaagatatacccatctaagcattttacccagtgctctggaaatactgaggtttttttactttggtggaaaaatgaatttttctagtcctatgtaagctctctttcttatgattcttccttctgctcttctagatcattcttcctcttatagtttccttacacacatatttaaatcatttctcttttctgtagttctccagagcaatctgtgcagatctttcccctttggaggcctgccctgtgaactccagttacaaaaatctctccagactccctcctctattttgtcttctggagacaagctcctctacagatcattttcctgcacagcagcctagaaattctctccagatctcaagcttagcaatagtagagctccattgttttttttgttgggcacagtgatagctttcctgcattgcctgagaacttttattccacatattttgtcccccacttttttttactacttcagatgggaagggaaattctatctcattgcccaattttggccaggagcacaagtctgtattgatcttttagaaacgtgtcttttttgacttattttactggttgttttagatatcacaacatagatatttaagttatcacagttaaccttcaaataaaattatacttttaaacaaatgtttaagaaacttaaaactatatatttctattcactcctctgctttttatcctcttattgtcttatatattttctctgcatgtgctgtgcaccagttatatttttattgtttatattttaaactgttaatagccattaaaacatttcaagaagctaacaaaaaacgcttttatatttgcttagatatttaccctttttggttcattattctttcctatagttctagaatttcatctggtttaactttccatcagtcgtaggcaactattttttaaattgagattagtttttcaagactaattctagaaaactaatagaagaaaagatgtgctttttcctagaagtaattattgtttgtctcagtctttactattcttttatacaaaatgtctatgctatgaccaaaaattacaagatacatatagaagcaagaaaatgtgactcatacagacaagaaaagaaacagttaataaaagcagaacaaaaggtagtccatatgtgtgaataaaaaagcctatttagtcttcatttctgaaggatattttcattgtatatggaattatgtgttgactgccttctttccgactcttcagtattgttattctgttaattttggtctctactgtttctgatgagaagacaactgttattgttgttctttttgttgctttagctccatttaggattttctctttgtctttgactttgcatgttttcacacttgtgttaggtacagttttctttgtatttgtacttcttggggttgagtttttaatctgtgggtcaatgtccttcatcaattttgaaaagtttgcagctattttgtttttaaatatttcttctgcactattctttttcttctactcctaggactctgattacatgtgttttggaactttccatattgtcttacagcttttcatcttgtgccacaggtgctcgctttttttgtttttaataattcttgtctttgagtttcatttttgttactttatattgatcgtcttcaagttcattggtcctttcctctgctgtgtgcattttgcatttaaggtcttctcttggattctttattttgatgtagtgtttctaatttctagtgttttcatttggtttaagaaatagtgtattttcctgctgtaatcacttagctcctaaagcagcagtcccaaaccttttttgacatcagggaatggtttcatggaagacaatttttccatggatgggggtggaggggattgtttcaggatgaaactgttccacttcagatcatcaggcattagattctcacaaggaacatacagcctagatcccttgcatgcacagttcataataagattcgtgcttctatgagaatctaatgatgctgtggatctggcaggaggtggagctcaggaagtaatgttcacttgcctaccactcacctcctattgtgtggcctggttcctaacaggccacataccagtactggtctctgtcttaaagcatgttgtatacattttccacaggatcctttagcatttttatcctaaataccttcaagacccagtctgatatttcatcatctgggctatctccggttctgcttttaataactgtttcttctcttgtctgtgagtcacattttcttgcttctatatgtatcttgtaatttttggtcatagcatagacattttgtataaaagaatagtaaagactgaggcaaacaataattacttctaggaaaaagcaccccttttcttctatcagttttttaagatgaaggtcaaaattaatctgatcagttattgaactgggtctgggctttgttgcagctttagtttgtttcacttactgcaggctttagttattttcaggattgtttgggattctcctttttgcaggatttatgctctggaattgccaatattgtggagatctttttatgaatttcaatagagttgacggctttccaaactgtgtgaaaactctctgctttctagcctgcctgccagatttataagttgctagagggttgtctttgctcttcagcacagctcctgagttttcatggcttaggagttttttttaaccctgctggcctgcccaagccttctgagggcaactttattctttgaagccttgaaatgacttatattttaagatgtgtgcaagatatctggcatttcttctgacctttggtgcctctgatgaatatcttttagctctcttgtcatgctccttacctctggaggtgggctgctttgtaacttgaggaggtaccatatacctcatgggtgatcttcctgacctgtcccaagctgttggcacactatctctgagcactcagtgaagacccttagaaagatttggcaggtggattcaatctcactctgtacctggggttcttcagaatattaatctgccagtccatatatactcttatttatgtttttaatttcagctggattcttcctatccaaaattatggtgtgtttttctttgtttttttcttgtttttgtttttaagtcctctcagaactcttccagggatgtgatcagctaaggtctcttctctcttataaagcacttgtccttttctggaatttagttaatttttgtttctttatgtcttgaactggtatatttgaaaaaaaagtgatgcagcttatctggtttgtttcgtttgttagagtgagagaaaaacttgtggcttcctacatcataaacgacacagtagggttgtgtgattaaaaaaaattccctatttatcatgcctgacaatttcagcagttaccatagtatagagaaattctaaggatgatatttcccataataacttccatgtgattgaacagaacaatttttcatttccataagaccattcttcaatttcattctggacttcctctggatcctaaccttaaccagctcttgggacagatagagtcacgtagtattgattcctcttaattacacgactcacatttatgtggtacttctatagggattcaagcatttttcctgctatatcccccaatcctggagcagtgtgtgccagacagcaagcattcaataaacatttgttgaatgactatttgatccttaaactttccctgaagatagacagaaaggggacataactcccctttattaaatgttgattttctgttaggaattgttctgcatggtttatacacatttaacccttaaaatatctctgtcatacattcttatcaatgtcttgaagaatgggaaactaagctttcaagcctgtcagttggaggtcagctttactagaacccaagtcaacttttggttcttgaccttttccatgctaccactctgtttctcataaaatgtctctcccaataagagaaaatgaaagaacacagggtctctagaaatccttccccttacataattgagacatctcctttcaactctaaccaaagttcaatgtgtgcatcaaggaagaagaggcttgtgataagaatcaaatgagataatgtagggcaagtggttcacagcctagaaaatgccactcacatggaattagccagtgcacccagcagtccaggaaggggcatagcaggtagatctgcagccccatggttgtgctgtttctgccttgctggctgcaatttcagccaggccccagggctgggtatcagggttacagcacttagaaagtgggcttggtgggagaaagttagtcaccattctcatgctgggagtacacagtgatgggtccccagatgctgtttttttctctccctgtcttcttttcttaaaattttattttttaaattttatatataaagaaaaatattcacccacctaatttttaagttttaatggagatggggtgttgctttcttgcccaagctggtcttgaactcctagcttcaagcaatcctcccaccttggtgtcccaaagtgtggggattgcttgcgtgaaccactatgcctggcctggaaccaacctttatggttatcagaactcccgtcacttagttaactgtctcaggtatgaaaatgtcctttcttatatgtatcaaaactcatactgaacaatgagttctgggttgcaaaagaggatttattttttgcacctgtctgtaagactttatccacaagttaagcaaaaacatgcacaagtctaatctccctgtcttcttaagaggagagccagctttcttacccttgccatcttgttctactcccaaggggaattcttgctcaaagattcatgccccagacttcccgcttgaacttcctgtgctcagataattctcattgtagagtcaatgaactgctggtcatccatctttgtttctgaagtcctacctatcaaacctcatgaggctaccccggtgggggtggaggatgagggatctttggtgaataagataacttaaaataaaagaaatctgaattggtctatttttaaaagaaatttattttcatttctttcaaatatgcaaattacctaggacaagatgaatagcattgtccttaaagaccttgctttggtgaatagccaaattagatccataattagcacaccaattgtggttaaaagtaaagtggcttaaatgcctgcttcccctccctcatcttgtttacattattaatttaataaagtgacacttcaaagaatagaaggtgaacttcaagcctctaatttaaattacatttagtggtcacaaattaaactttgagatgtttcccttattataatagtatcgtatgctgtgttttagtgattacaaagtattttcttacatatgggctccttttgtcttcccaataaccttatggggtgagcagggaagtttccttatctctatttcacagatgagaaaatgcagagtctaaggcattaggttacttatataaggccatacaatcaaagatcagtcagttcgttctattctgattcttcagagatttactccatttctaatgatatggaaccaaagcaaaacaaatgcgaggcatgcaaaatgggtaattttattcattcttttgctccttcattcattatttcatttccttattcattcatttttattcctagagactgctactatccctggaatgtaacaaatgtctcagtagggtacttactgtatgaatggaaaggggggaaaatagaataatttactctatgtagtggagtaaaggtatcttacctgttcatattgccaccgaccccacactgtgccatacataaaatcctctgaagtagggcaagtaacatggtaaacaatctcactttatcagctttttcttcttcaggcaagtctgtagcatgtgctggatgacgatttgagcaattggaaacttttaagtgttcagatggccattgatgtcaagcccataaaccctcaccttctgccttgctcttctaagccttctgttctcatattagctccctggtccatcggtccattctctgtcttcctcactccctctttctctctctctgtctctatcccttagtttctttctttcctcctcttttttcctctttatcttcttttttcttctcctcctccattcccattcccccactctctccctctctttcatgttttgtacagtgtgaaattaaagactgagtagcatgactgaagttaggtatttccacaaaataatgacccaggattggcttcactgagttttaagacatgccatgggtacttcacgctaaagtccatttttccacatgaaacagccatattgttaaaaacatttggagagctgaactttccagatgattaacataagtatctactttatggtttgcatttttcttctatattaaggacctgtccaagaagtatcaagtgtaactcaataaaacattagcttctcttttgctgaataaaatttcagaacaataccttcattaaagttacctggaggcagctttggattcaatataataaatctgcaacggtctcccagctgctgctgaatgtcaggctcttagcaagtccattcctaactgtcttcattcctaagtggcccctatgcttctaattcctcagccccaccatccttcccaaatactcatccccaagagtgacttttctaaaaaatcagattttgtgaatcttctatttaaaatgtcaatcttctatttaaaatgtcatttggttcctcgtcagcaatgaggtatggtgtgaacttctcttgctgtatctggtcctttgtgacagtgaggtcatctgtttaggcctgcctgcaactccctccctgactttgtacctcccctcttccctaggacatctctgcatgtttgcagtgtatcctttaccgtcttgttatacctcacttggtggtggaaatggagggaaggggatatatttgagggctatttcctaggtccccaatccatgaatccttcatctattttaccagtcaaaatgaatctctctttccttggtgtgttcctgcattagcctcggcacatcctgtcttgtattgcaattatttttttatgtgtttctttctttcctggcctatgaatttatatcttattcactaccctttcagggtgcggagctcagtgcttggcatattcttgctgttcggtagtaggcagccactaagttgttgaattgaactcttctgtgtgcttgagttggaatattctgaggctaagatcccctcagtccttagaggtcagccctttgtatcacaggcggagttcagcaagaaacaagtgtttaaaattcattttctcataagttagaacttctgaccaagacttcattttagaaacgtatcacagaaatgctgagaattaaagcatttctttgcatctatagaagatggtgactcagttgttacactaccttttgttgttgtggccccaggatctcagacaatgcattcttacctcagatggggacataggaatggttttggcaatttctgtcatctgcctggaaaatgggtatttttggttattttcctatgaaggaaagaattcaccacttcccccactataagatatttagatttgagtttaatttttctataattataaatcacattcctggattttgttgataaagttttatttaatgtatccaagtctggtgactaacatggcaaagtaatatagcaaatatttgaagtcagaaggctgactctaggctttgagcaagtcaattaccctctccaagggtcagtttcactggtagaattgggatagtgatgcacccaccttacaggattgtcagatgaattacgtgaggtggttgggaatggactttttggtctgccaggtgggctgtagaggaattctcgctctggagatgaggaggttaggggcctgggatggacaattgaaaaggtccttcccagcactgctatttgtagatttatcatttgtctcccacattttctctttggttggactaagattaaatttcatgtgtttgttgcatatgtgcatatatctgtcatcctgtctaagactcaaccttttttggcaccatgggtctgtttggtactctggtgaaggtgatcagtcctttcacagaatactgtttttaaatacataaatacataaaataaaacattaggctgaacaagaataattatattgaaatatagttctatatatagatctactggggactcatggactacagttaaaaatgttgggtgtctctgccaggcgtggtggctcatgcctgtaatcccagcactttgggaggccaaggtgggaggatcacgaagtcaagagattgagaccatcctggccaacgtggtgaaaccgtatctctagtgaaaatacaaaaatcagctgggtgtggtggtgcatgcctgtagtcccagctacttgggaggctgaggcaggagaatcgcttgaacctgggaggcggaggttgcagtgagctgagattgcgctactgcactccagcctggtgacagagtgagactctgtctcaaaaaaaaaaaaaaaaaaaaaaaaagttgggtgtctcaaaaatttaaaatccagaatggaacttaagagtcacaaatttcttcattctcactttacagatgaaagaagatgtgattcccaaagacagttccctcaacttggttcagaatcaaatagggagttttattcggtgggtatgcacaagaacacgatagttccattgacaatctttccagccacaaatttttggaattatttgtgccttggctcttgtttctagctcaagacactgtagacttgctggattgaatgctatttggagagatttaccagttgatcatttcaacccaaaacggagatcacaaatggagacttcctaaatattcagtacacccctccaaagtgcactcgctccatcaaggttatcctagtattaattattcataggcagagcactgacaaattctaattgcaaataagtgcaattgctgttgattgcataatttatgattccatttgttaaactaagacaatgggagttgatgaaaggcattaagtggccccaaattaaaggtaaattgggttcaaaggcttgtctttctgtgaatgtagcttgaagttgtctgctttcctgagaccctctcacacactggtgatttatgtaccaggtaagctgtgttacatcaaatcttgtgtctggctggagatgcttcagtctgggcttcctggagatctgcactgcagcctgtggtgagatggcctcttgcctcagtgaggctctgccatctttctctgaagctcagggcctggcctctgtggcttggcttcaagacagcctgattgcataactttgtctgcattgctctgacactttgctgaggggactttggacaagatggcaaaattggcactggagttcattggaaatgatttccttgaaaatgaggcaaatgcttttctttccatgtgacagacactcccacggatcagcatctcacagaggttaagtgcaatctctgcaattgctcactgctcttcctaagaataatacaagacaaagactgtactgaagatggaatcttttgcatagtaaatctcaagataagtctgttaaataaaaggtggtttgaaaggagattatttatggggtgtgcaaggaggaatttgatattcaagttgtacattgtgagaattcattgcaagaggtctgacttccctttctttgaatatatagagctggtattaagaaacatttggactttgaatcttacagatttgttctctaaagattaaatttcatatatgcacaaaagaagagccccaaaacaatggactttgatataactgcatttataccatgtactgtgattaattaatgaggaagtgatgggctcattaacttctgattatgtgtcttgtgctgcagtgggacaaaccattgacccagactggtgaccgtcttgataacatcagtaagatggcctttgccattaaaattctggaactaatgagtacagaaaaatggaagtttactctgcttaacaaataaaacgttgtttattggttcactggagtcaaagggatcagtagataagtcctattcttgtatgaaaatggtgaaaagttgaagttgggcagagcctaagatgcagtgagtacaacatagaagggaaggctggagaattatgcaaaatttggagggttatggatgacatgcttggacttgatcctgtagttaatagttattcatatggtacttttaggcaggaaaattatagcattaaatttctgtttcagaaatatccctctggatgcttatgcagagaattgatcggagagagcgagcttggaggcagaaaagccattcgggagttgaggccacagtctaggagagagataatgctatccagcccgtggaagtggcagtgggtatgggggatggagaggaagagacagatggagaggcattttcagtgtcaaattgacagaatgggttggactggcatgccatggccatgtcttagaaactttaaataacgtttgtgggaaaaataaaccagagcttgtcccttatacagaggccagggctggaatcccagaggagatagaatatggctcaagggacagctaccaatggagtgggaagtcctgatattctgaggctgggttgtagccctctgtcaccacaaaggagaccaagaaggggaagtgattcactcaaggtcacttggcaagttaattacactcttggctaagccttctgagcagaatgggagctgcttccaagaagtgcagatgctcagtggtctggtggctgcctcttctggattcctggtttgagctctcacaagagctctccttgccctccctggactgggcccttatcctgggctcactgctctatctttcaaacaactctgccttttacctgcagttttggggtggcccaggcgatggggtggagctgaggaggtaatcctgcctgggagtgaatgccactgtgtgtgtgcacgtccatgtgtctctggaatgctgacagcactgggttgtctcttgcctgagcatcacttgaccatcctgctttaaaccggaggagaaattctatcaaatgcaagcccactcagagcttgtttccttctttatcctaaataatttcaaagtgcttcaagcagttttataaaagcaaaaagcaagcagctgatttcatttggcgacacagagggctaaattaggtcatattatgttaggtcattcccagggctaattaactgattgtcctcatggtggcccaaggagtcagctgtgcttgcagctgtgcctaacatagacctactctgttaacgcattctggttttgctttctgaggtttcagttacccatggtcaatggcagtctgaaaattttaagtggaaaattccagaaataaacgattcataagttttaaattgtctgccattgtgaatagcatgatgaaatctcatgtaatcctgctctgtcttgccggggacatgaatcctctctttgtccagtgtctccatgctctctaccctccccacctgtcactttgtagccctctaggttgtcagatcagctgtcacagtatggcaatgcttgtgttcaagttacctttattttatttaataatggcccaaggtgcaaaagcagtgatgctggcaatttgaatatgccaaagagaagccataaagtgctttctttaagtgaaaggtgaaagttctcaacttaataaagaaacaaaatcatatgctgaggttgtgaagaactgcagtgagaacaaatctatttgagaaattgtgaagatggaaaaagaaatttgtacatagtatatataggatctcatactctatgtggtttcagatatccaccgggggtcttgacacatatcccccatgaataaggggggactactgtactcacagtctaatgatttgttcacaggggatttacatcatttgatcatctcaaaagccttgtgtgacaggtgagattatgaactgtttcataacggaggaaactatggctcaagattaagtcatgtgcctcagggcacattccagccactccctgcccccagactgccaggcctctctgagactattaaatcctcccttggcactccaccaacctatctctctgtgaactgagcattcgatgctgctaacatgccctcctcaaaacattccacccctgtgactttcatgacactgtaccaccccctctgtgcagttcaagggggacactggataagatgattttctcaaaaagtcctcagaacgtcttcaccttctctggcttcattatcttggtgtaggacgctaccaccgccaccaccgccttcccgttctcttcttcctcatccaacatttctggaaactggaccagtgctccttccaagtccttctgtatccgggcttatcactgtaatggattagtcagggtgaataggggtttggtgctggggttctcaacaccgaaagtaattctggctacactggaatgcatttttttattagtcagtacacaaatgtatacatagtccatttgtttcccaaattaaaatatttcacagtgtttagaaacagaaagtgaacatcagaattctgtgagggtatatttatggaaggatggatttttgcaagaaacatttgatatgctgtactatattacctgctttagctgccataaccaagaaccacagactgggtggcttaacaaacagaaatgtatttccttatagttctggaggcttgaaatccaagctcacggtgctggtgagttggcttctcctgggccactctccttggctttggatgtccccagccttcccctgtgtcttcatatgctcttccctctgtgtgtgtctgtgtcctagcctcctcttctgatgagggcacgagaacccaacctgatgttttcattttaacttaattaccttcttaaagaccttaaacaactctgctttttacctgcagttttggggtggcccagacgatggggtatgcaggtatgttttaaagaccttatctccacatagtcacattctgaagtattgggggttaggattttaataagtggaatttgggggacacagttcagctcacaacatatatagtgtatcttttccagataaaagcaaacactgtaaaaatataaatatagattaaaagatacaagcacaatatttttctggatttgctcttctgggtactatagattgcttagcataacaatcatttttatacatttttctttcaaaagttattattctcaaacagcggggaaggggtggaacctggaaaaggtgttgattaggtgggatgatgggtctcacctgacacatgaagccagggctgatgggctgatgtggtgggtgctgtatccaatggcctcctagaagaacaggtgtgcctgctgcagcagcctggcctcaggtggggctcttctcagtgtcccactggttctgggccctgggcacatgggcctgcagagattaaatggggactgctggagctcacgtttcccgttggctgggtcctgtgcttggctgtaggagactcaggcaggaatccacttgatcctgaccctcggggctcacaatacaatggtagagacttatctgtctgagaagataagaagtgagaagtgagaaatgagttcaagaccatgctgtgggagctcgatgaaggtaggagccagttttactagaggctgacccccttgcctgctctgacacacaagctaggaaagctatgaaagttcagaggtcactccctctgaacaaggcactgactctacccttactgaattttactaatcacctgtgattaatgtggacatctttctgtttcataaataagaaagctgaagctgagaggattttaaattttcttatgtcacacacctggatagtggcaggtcatctactcaaaaggtgtttctgtttaaaaaaaaaaaaattccacttgtatttaactgtgagaggtgttcataaaccatagctttgcacacaagtgtagacccacaatccagatacaaagagaggatgtgtgataggaacaccggaagaatcattctgtctctgctccagtcagagacccagaagcgctgggtgtttcagctctctccagccagtggtggtgactcctcaggtaaactggaaagtcctgaattccataggtggctcagacaatctgcttacttgagtgagagtgaggcacagtggccatttgccgaggcgtgccaccctcactccaggaaggggcaacttttccttgtgtcagctgcttcctgggtatctggatatgaaagaaccacaggatcctcggatctcaggtaggggcgctgcctctttagtttctattagaggtcattgcgatgaaaaggccaagagctttgaagtcagatggatctttttccgtgttctagttcgactattttctagctgtgtgagcttggtcaggttcctcatcttctttgactctgttttctgatgtggaaaatgtggctcttagaaagattttaaagtaacacataaaaatcccaataacattataatgactactattcgtgttattatctgagagatggagggagtcacttatctcaaaccctcaattttcacatgcagaaattaaggctcatagaaattgtgtgccttctctatttttttttttttttgagacttttgctctgtcgcccaggctggagtgcagtggtgcaatctctgctcactgcaacctccacctcctgggttcaagtgattctcctgcctcagcctcctgagtagctgggactacaagcatgcaccaccacgcccagcttttttttttttatttttagtagagacgggatttcaccatgttggccaggatggtcttgatatcttgacatagtggtctgcctgccttggcctcccaaagtactgggattatggacatgagccaccacgccttgtcaattgtgtgcattttttaaagtcacgggtaagactcagaagggctgggacttaggaaaacaaagtgtttttatgtttctttttgtaaaatcttgcaatcatgtactgggatctcaaacttctaccatggcccttgctaagaatgtcttttttccagcacatctggccccctttggtcttctcctctctgggccccaccgatctccctgctctattttctcaccaccttctccatctctcatgcccaccccattgcttggtccagggaggttcctctaaatttttaaggatggtggaggcagagagtcatgttccttatcacaatgtttctgccacattttgccttgcctgaaggcctcttaggcttttggaaagcaaagtcgagtccttttctggtggccctgttacatcccttctagatgtaactgagtatcaagtggaggagctgcttcattagtttctgtagcaccacagaagcaaagtaatcaatattgataacagctgctatctagtgagtgctcactgtgagaatgcactgcagctgctctgtacatgatctaactttaactatcacattcaccaggtgagatgaggttttctaaccttgccttactagggaggaagctgaggctcagagagactaaatgactggtcctaaattgcgaagctagtatgcagaagtgagacccaaactaagagtaccaaagtctagctctttcttttccttttttctttttgttttcaagacagggtcccacttggttacccaggctggtgtgcagtggcacaatctcggctcactgcaacctccatttccgaggcttgagcaaacctcgtacctcagcttcccaagtagctgggactacaggtgcatgccattaggcccggctagaaagtctagctctttctgctgcaccaaaatagttttctgattgatgagagggaggaatttatgaaatggagacaacttgaggctaatgcaaaccctttaggcgtctcttttttaattggttaaatcaaaatgagtctgagcatgtgcaggaagcctgtgtgcttaggagactgacatcgggtcaattcactgaatgaacagaacctcatctagtcacatttccataacatatgaggagcttgggaagcataggtgtggatgtactggttgtagtgaacttgaaaagctccagtctttgtatttagaaagccactagaataaaatatctggggcattctctatgaggagattaaaagagagtatcaaagatgcttccagattttggtattcctcagttctaaatcctacagacatgtatgattacattccactttaattagaagaatattgatgtctattgactacctatagcaatgtggagaacttgaggtagggtgaagtgggagggaggagagcggtgctcacatcaaacgttgagttggagtaaaggagcttcatctctcttgtccaggaagaagaggtgtgagtttatgtgcaacccaaaagacccaggtctgaacaaatggaaacaatcacaatgggaaggtttgttagaactatgggcaacctttgtggggtacaggattgagaacaactcatggatctttattttaattttttagcacatataagaatcatcattccccttcttttctggaagttagagatgtagccaagaaataagagccctgacattcttgggagcaagaggtgaggaggatgccctattctgaacagtagtaatggcagatggtgggtgggctagaacgatgtcctcttgctgtagaaacactgcatttccaagaccccactgggcctcccagtataaatcgtgtttccaggatgctcaggggacccatcttcaagattaacctcttactgaagctccaggcagattcctatagaattaccaaggagattcctatagaacatctaaactgtccaacaaaagattttaaggtatggtgaaaaagagtgatggtggccagagaatggtgctgcagagaaggtataatacctacactcctttcaagggaggcaaactaaaatactatgaggtgaaaaccaactgatgcaggaacaagcagatcaactccagctttcattagaagcagagccaacttgaaatctgcatcatatatggctttaattttaagctaagttctgttttcttctgcttttccataatggtaagtccacatctaagtctcagtacaccccttgctagccataagacaaccattggagcacaggaaacccattcataagttggttgacttggtgtagtgacagacaaagaaggggtgttaataacccctaagtgatagcccccaaagaataatgctacttcccccctcaataaaggcctccaaccatgaccacgctctaatctctggaacctggaaatatgttatcttacttggcaaaatacactttgtaggtgtgtttatagttaaggacctgaataggtgaagattatcctgttatccaggtaatcccaggctaatcaccaaatccttaaaagtaaagaatatttcaggtttcagagaaccagagggacagcagcatgagaaagactcaacctaccattgctgggtttgaagatggagccatggattacaggcagcctttagaagctgaaaaaggcaagggcacatctacaaaggtgtattagtccattatcatgctgctgataaagacatacctgagactgggtaatttatgaagaaaagaggttggctcacagttctgcatggctggggaggtctcacgtaacttacaattatggacaaaggcatctttcacagggtggcaggagagaatgagtgcccagccaagggataagcccctacaaagtcatcagatcttgtgagaactaactcactatcatgaggacaggatgggggaacccacggcccacccccaccctgggggggaatatgggaactacaattcaagatgagatttgggtggggacacagtcaaaccatatcaaaaggaatgtattattgctaagatattgacttcatcccactgagatgcatgtcagaattctaagccacaactgtaagataataaatttttattctttaagctgccgagttggtagtaatttgttgctgcagcattgaaaacaaaaatagcgtgagaacataaactgtctgatttgtctttctattctaatctttctattcctgattctttgcagagtgatgagtatatgaacgagctcagtaattcttttatgaatgaaaaaaatgaagggaggaaaaacaaaaaaagcatttgagtgtttggccaagcatagctgttatcagattcaatggcactcatttgttcaaacaatatttcttgaggcttcctgagcccagcatgatgccaaatactaatgaggacatatgaaggggcacaagcaaagggtgctcccttaaagagcttctgatctaacacatctatgaatcagaacaatcaggtcgtaacctgtgagtgccacagacctcagaggagaaagagattcccgaggactgggatggtctgcaaggtcctttttggagaattgaggcttcaactgggtcttaaagaataatcagggtgatgataatgtaagggcattgcaagcaggagaacataatagacctagaggataagaaaaggactatgaggaaggcatggtaacttgggtggagctaaaatgtagaatgggaataaagtaagccataaatgtggggtaaattcagttgtttactcagctaccaagccctgactactagtgctaggcataaattggggtttggggaaataaatgacattatccccaccctcaaggaactaagaacctagtgggaacataaatgcctagaaattgctcaatatttgatacttgttagtagatgtttaataaatatttgttcaattaaacacagttgaaatgcatggtcaacagtattagtcacaggtgaggacatagatcattttttcagcggttatgttatttattgctatgtaatatattatcccaaaatttagcaagttaaagcaaggaacatttattatctgacattttcagttggggaggaatctgagcatggcttagcttgatgccgttgggtcggggtctttcacgaggctgcaattagggagtcatctagggctgtgattatctcaaggctcgatggggagagggaaatctgcttctaaggtcattcatgcagtggttggcaggattcaatttcccatgggctgttggatgagggcctccattccttgctggttatgggctggaggttgtcctcagttcccttccatgtaatcttctctagagggcagttgacaacatggtagctggattttctcaaagagcctgagataaagtaacagaaagccagagagagccagagagaaagagcaatacaggaatcattgtattttgtatcgtaatcttggaagtgattctccttcacttttgctgtattctatttgttaggagtgagtcaccagctccagcctccattcaggggaagtattgcacaaaggtgtgagtacgaggagaaagcagaggctgtccatcacagttgggcagcctgatgtaccctcttttcctctgtactgtagaagcgaggctttctctgaaggtatcaggcaaagaaagtagagaagagcccatcctcattcatctggaaactactagctctaccacagccaacatagttcgcatcatggttcctgcaggacatttagggaggtactaaccagagaccattttttcatggcttaacaaaaaatctagattgggaaaaacctcagaacatctcagactaggggcttctcaggaaccagtaatcaaggccaagggttgaaggagaggtagggatcctgggctattgatattatatagaaaataatattggctaaaaatagaaaagctggttttgaattcacatagtaggtatgatgttaaacacattacttaaactctctgagcctgtttcctcataaattaaatgggcatctacctgtagtatagtcattcaggagattttgaatatacttcccatgtctgaggaacctccatcattcctaattccctgagaaaatcattattccagcttctcttacagctctggtataggcatgtgataaaggttctgtcaaatcaaatggctggggagaggtactgatttaaactgtatttatgagaaaaaggacaggaggagcaatgaattttctagagattgtagtggcagaggctttgattcttgaggccaccttattctggtccaactcagtgtacacagtataggccatggcataatatggtgtttgatgcctgtgcccaggggaggctgcaatgaggtgcctattggagcactcctgcagtgtggcttgggtgtcattcccatctgcaaagctctaatttgaccttctgggatgcctggagattcagatctacatttgtgagatttatatatatctcataaattacattttacttctgcttaaactacttaggatgtgtactgttttagcaattgagactattgactgatccactgcctctcagggtattatggggataaatgagataatgcatgtaaagcacctggcacagtgccttttatataggtggcactaaggaaatggtagctcttaatgtttattttactactattccttcttgtcaatgtttcttgggtacctcatgagtgaaagtcaaatctcagctgcatgcggatagaccaaggatttaaattctgatgacatggtttgggtctgtgtctctgccaaaatctcaagtcaaattgtaatgctcaatgttggaggtggtatctggtgtggagtgactggatcatgggtatggatttcccctttggtgctgttcttgtgatagagttctcatgagatttggttgtttaaaagtatgtggcacctctcctctcctctctttcttctgctctggccatgtaagacgtgcctgctttccctttaccttctgccatgattgtaagattcctgaggcctccccagccatgcttcctatacagcctgtggaaccatgagccaattgaacctcttttctttataaattgctcagtcttaggtatgtatttctctctctttctcttttttttttttctctctctctctctttctctctttctctccagaaggagttccactcttgtttcccaggctggagtgcaatggtgccatctcagctcaccgcaacctctgcctcctgggttcaagcgattctcctgcctcagcctcccgagtagctgggattataggcatgcgccaccatgcctggctaattttgtatttttagtagagacagggtttctccatgttggtcaggctggtctcaaactcccgacttcaggtgatccacccacctcagcttcccaaagtgctgggattacaggcatgagccaccgttcccggccctcaggtatttctttatagcagtgtgagaacagactaatatgcctgggtagttttgccccacagggggtgttgggtaatgtctggagacagttttgattgtcacaactaggggtgtggtgtaactggcatctagagtctagggatgctcctaaacagcctacaatgcacaggacaggccccatagcaaagaactatacagtccattatctagtcaacaatgccaaggttgagaaaccctgttgtagatgtgggtgcaaaatgaaacctggccaccactctctactctgtcaataaaaacctgctaggttttgctcaaccaggatgagttccagcatgtggaacctccagatgcaggaacaccagagtgcaaatttaatcacgcaattttatgtccctagaaagcactaccaaggttgtgagatcagggcatggaatgatctaagttttcataaatgtattcccaaggtccttgattaagcaattaaaagatgaattaaggactatgccaatttctgattggttggccagtacagctgggaagtttctttgtttggttttgatgatgctgttttaatttctgattttttctgtgccagggaatcttggtatttcctttgcagactgtaaatctctattatgcccacatacggcaatatagagtctctctgcagttatgcatttttattggtacacagaatattgaaacacaaaacatcaaacaggctatttcttttaaccacagatgtgagttgaattcattaccaatattgttcttcgacttcctaatgactttggctcattgcaaatggaaaatgtgtccaagagaaggagacagttttaatgtagtgccactggtcagcttgtgaccctcattttctttcttttcctgagcctcatcttttctttctataaactgaaagtatgcattagatgacctctaagtcttccaaatttctgagattctcaggggctgccaaattcccagggatttcagagccctccccagaggaaggtggcctcatgagtttgttggggcatggcacaaatccagccccaacttcagggtcatgggcaggagtcaaggtcacctcttccttgtaatgttctcctatgaaggccttgtaggatatgctggctgttcattaattcaagtgctcagttgtgatgaggatctcctgggaaatacaagtacaacaatatttttcattttcattgttgaaaagtattcaattttgtaaaacatgactaatttatcctatctattgttgatgtcattttgatttttcagttttatgttactatgctgttagaacattcttgtaaaagtacttggaaaatgtgtacaatttttgagtgtatacctagggataataggatatgcataaatataactttgattttgctaaaaatggttgattgattttatactccctctagcaatatattagaattgtctatctttttaattttcatcattgtagtgagtatgcagtggtatcctactggagttttaatttgcatttccctgatgactggtaatgttgagtatcatttttatatacttgaccatttgaatatcctttataatgaagtgtctagttaaatactttacaatttaaaaataattggcttgtttgcctttgtcatactgatttataacagaacttcttcatacattctgaatatgagttcttggtcaattatatgtatttcaaacattttgtactctttgactaggtgtctttaatacgtgaaagtttattaattttaaagaagtccaacgtatccatttttaccatttaggttattgatttttgtatccttttaagggaatctttgcctaaaccatcttcataaaggtatcatcctgtgttgtgttttaaagctttattgttttattctttaaatgtcaacccacaatcacctgtaattgaattttgggcctggtgtgtaataaaggtcaaagtttacttttttctatgtggaaaagagtaccatttatttaaaaatgccccattttaattggtcttcagtgttgcctttgtagtaaccaaaagtccataaaggtgttggtctatttctggtcattctattctgttgtattcctttatactaatactaatactaatgtccaataataacagaaacattattgctgtcaaattacttgggagaaaaagccacttctgcagaactgaattgtttattcccctccagtgggatcacattctgttggaaaaaagtctgaattagtggttatgagaatagggtctagttcagattctgctcctcatctgctatatgatctgaagcaaaccagtttccctcttttggcattagttcctcatctgtaaaagccaggagatgctgttaataaactctcagaacaggttagttgagaacccacacacatcaaagacatggcaaagacacagaaaggaggccctaggaactaaaatatctggacattttttgaaaacgttttcccaacaacatgtttaatttcagtgttttcagtttagttgaaaacagatgaccttctcagcatagtttgccatatgttaatcaaattgttagcttccaaaaagtgagctatgtttattctcatgttgaagtgaatgtccttgagctgctatcaagtgatcaatggtgtgagctcctactctctctcctgtggctctgacctatcacatctctccaggttgccaactctgtaacatgctattttctgatagagcttctctgtacagcatgtgttcccatgtctcaccctttttgctctgttgttgcctgggatccagtgtttcaacagagttcttttgtggcacaagagcacgtgcattctaggctagcatggcatgagagcatgatcctccatagctgaattttagggagcagaattccaaaggctctagtacatgataacttgtaaaggaaagttaagaaggctggtgcctgcagcctttgttaaatgaaaaattgagaaccaggaagtccaattggagtggatgagtgcttctaatagagtgcttctgagaatacatggtaggaaacctttgtgtggttcctgggcataaagacccatggaaagaaggtcgtggaaaagagatactggaagctctgacttcctccatgtacatactggacctttctccttcacccataggtagatactgctcctttaggtctaatgcctgtaccatagcttcccctcccttacaagacctgcgtgacttcacaatccatgtgagtaatgtgatctgtacctgggccttacattccttcacttcctcacttggtggcctcacctttctcttttattttagcacccactcttcagcatcacttggaaccacttcgtgtcagagatctggtcagggtctcatccgctcaagaaacgaatgctttgtttcacaactcctgttcttctgtttcccagagacctctagttccttgatctgtctgcttcctgccagttaatcagctccccttttcttacttttcttatctacccagcctgtcctgagtagttgaacacttgaataactctaatactaggatccacaatttgtaggtgtcttaggattctactgcccctctaaagaagctccttgctcactgtggacttgctgtttgttttcatcaagtgagacactatggtaaccctcaattttttattcctcatccataaacattttatccaggttgccatctatctttactgtctttcattcagcctaaagggctctactttgtcagtttaggcatctcttaagaaaaagaaaaaaaagaggctgggcgcaggggctcacgcctgtgatcccagcactttggaaggccgaggcgggtggatcacgagatcaggagatcgagaccatcctggctaacacggtgaaaccccgtctctactaaaaataaaaaaaaataataaaaaaatgagctgggtgtggtggcaggcacctgtagtcccagctactcgggaggctgaggcaggagaatcacttgaacctgggaggcagagcttgcagtgagccgagattgagccactgcattccagcctgggcgacagagcaagactctgtctccaaaaaaaaaaaaaaaaaaaaaaaagagaaaaaaagaaggaaagagtgagggaaggaaggaaagaaggaagcaaggaaggaaacattattgattgcaaattcttctgtagctaccacttcgttcttctcatttaaattcattcaaatctaaattgtgcttagtcactgtgctcagtgctgggaattcagagttgaataaaatatggtacttttccttaagtagcttatagtttcagtagagtaacatggaggtagagataagcattgcaatgagatcaaggcaagagagcaccagagaagaatgcaggttttgactcaaccatgggacagctggagtgaagagcaatgtagtgctgtcagagcatcagtgcagtgcagggaaggttagggagcagaattccgaagactgtagtaggtggtaacaacttgtaaatgatagtaagggaggctggtgcctgcagcttctgtcaaagaattgagaactggggaatccaattataatggatgagtacttctgaaaatgcagggtaggaaacttttgtgtggttcctgggtataaggacacagggaaagagggctgtggaaaagaaatactggaagctctgacttcctccttgtacttgaagaccttttctccaggctgatgagttaggctggtcatggcagaccaagaaaggctttgcaagccaagcaagcctattccgattttatgtcgctccctgaaagacagggaggtgagtaatcatttacaaataacttctgtagacagagaagaatattgcatccatcagagaatttctgttctccctcttgctataacttttctaagagcctacttgggtttctgcattggctccatagctggggagggagggctgtgtatatgcatggaaatggcacaaagaaaggtgaggatggagcatcgaggtgatggcctggtcttagacactggcaaccagagctgcagcatcccattcagcctctgactggagacagacatggtgctgaaggttggtttgccaaggtcaaaaggacacactctaggaaactgtccagggtgggctgcatgaagctggtcatgatctctattagttttgagcaaaaatgcttccttttctaccttcctctcctctctcctcctttcttcttttcttacctcctttctctccattcctctgtaaaggctgatcagagggagtggctgagctgagtaggggcagtcagtcaaggagggaggctgggagccttgtgttctgtccagtgaccctccctggatcctaaatgaggatggcctggcagctctgtgaaccaaagctttgccaaacgaatggggctttgggtgaattttaaaatatagcttttctgggcttaaggtgggcagcttatggtcttgatttcagccccctcatcccttggtcaggcacgctcgtgcagggcacaatctgagtgactgcagcagctctgtccctgtgggctttatttccaattgagaaacccctatcacagtgaacagctgggaaagccctccctgtacccaagtctcatcactttatcatagctggagtgctgacttccggccaggctctgtgcatttgtagccacgatctgacccacacgacaaagggctaagaatttggctacattggtgcattgtttgtttaaggcagaagtgatgactgacatttttttctctgcttagagggctttataaaattccatttgttattatctcataggatgggagttggtggggaaaaaggaaattacttgtcagcctgtataggaaaaatttctacagatgattgtgaggggtcagtcctttcggaagaaagttcaaagtaaggctgctaatgcttaaggttatagtctaagtctgtttcagtttaaaatgtccaataaattagagataattttatggtgattcctaagacctgacaacctaaacattttcctttgtagcataaccaaaagtaaactgtcttcttaggtaagaaaaagcaattgaacctgtaaggattaggtcctgcccttcagactgagctttaaaaggaagtaatccagcaagagatcaatgaaggaggagctccggctgaggtcaggattgtgatgagaggattaagtcaagcatccatctgtacatgtggccgtggggggctcaaatggacccctaatggcttcacttggggaatcagcagcctaaaatatgaggagcacagcagccaccaaatcacagctcagggggtcataaatatcccccccatcttctacacagtgaggaagaactgctcagaccacaaggatggtcttcaacacagggtccaggatgagagaataaaaagatgggcaataggcatcacttctgtgttttccctttttggatgtggtgtccagttgttttttcgcctttataaaacattttaaaaatggctttaagtgtctagtgttgagattgcttaattcttctaagccacgatgacaggctggaggatttggacaagctggctcttatatcctcaagccaaaagtaaaaccattttgctatctaaatggaggggcacaccaaaaccactttttatcttgtgctccctaatgactagaaatatgtaagttccccatgcaaaagaaagcacatctcaatatgatgcccttgattaatagtgatggtggtgataatatggcttggggcaaatatgaaaaatagtgcctgttgagctttagatttatgaagtagtgagatcccttatttaagccttttgaaactcaacagacactctgctgtacgtaagggctatgtcatagatctctgtctaaggagcatacatggggatcacttatctgagcctgggaatgcctgaaaaggctgattctcaccactccgagaaacattcaaagacttttggagtcatgtttcttgttgtgataaaatgctttactgccatcatacacttttctgcagtggccatattctagctgtttgttagaaggaggaggtcatttatgacactgagatcgtctgagtttgtgcagcacatgacgggcctgcacatagtaggcagtcaatatctttttatttgttaatgttggttttttttttcagtggaagaaaaattgttttgaaattgaggcatgcatgagaatttctggtgtaatctatctgaaaatttttatggtaggttgaaactagttttgttcactaaagacttctaaaaaattatagtaatgaggtagacataagcatacattacatttgtataccttgttgctctataacttatacacatattatttactttttataaccatcctaaaaatagcttttattaactccattttataaatgaggaaattagggagatggtggggtaaatctaagcaatagaatcaggaccaattttctttttttaaactttttatcttattctcttttggcatcactgctgctagaagatcttggctctagtttgggaggagccattctttagctgagtggctggaagcaaatcactgcctctttggtcttggttttctaatctctggaatctggtcttcagtacctgcctgaacaatctgagacccacagaaggaggcaaagaagattggaagtagaaaaggcattaggaattgtgtagtctcctttccttgccaggaagttacaaaacataaagccttcccatgaccaattctcttctacctgctgcctgctgtttctctaaaaaagttatccctagtccttttgtgctttcaacaatccctgactgaccttgaccctttagagaaatagaatagaacttggactctccatttggaatttttgataactatgttagaatgtgtcttcttttccctatggacttatttctgtattttggatctacctctgaactaattcccctgctatatggcgtcattcttcagccaagtccttggcctttatccagtcccaagtgtctccctggatatttgactctagacttaaccagtatgacctgttcttttgttactattatctcactattctggtcctgatagacacctggtttagctagccaatttttgccagcccagccattgatatttgcaaactttagactttctatttagttgatgaggttaaagagatatatctctcttcaaaactgcgtgcgtgcctgtgtgtgtgtgtgtgtgtgtgtgtgtgtgtgtgtgtgtgtgtttaatctgaggaaaacccaggaatctctagcatagttgttggttatgttctttttcaagagctcagcctgcctatcatctgcagtggtcctagcattcagttggaacatgtggaacaaatgccttctcttcccagactcaaggacaagggaggtcacacagatgttcaacagatgtcaagggaggtccagtgaagtgactgtgaagttgatttgtaaacattccagtaagaatggtttcctttctcaatagctattttggaaagggttttcatgaaacaagaatgtgactattaaatgtcatctcacttcacaaaacaatttctagtccaccagccaaactgcttgcagcaaacaagttgactaggtggccccatgaaagggtccgggtttgagtctagccattgctatttttccttgtgtagaaatccaaaggaagctctgttacttgcaataaacttgtgatttgtcttggagaaaaaagtgaagtatcttcagttgatatactctcaagaaatgttaacagcgtgtacatgcagcaatgtgaactggagatatgtggacatcctcactgaccttagaggtcttcgtatttgcaagaatccaagaatcttccaactgttgcagggggcggacccagagaattagatgttatccgggctgtttatcctgcctagacaggaatgtgctgggactatagaaacatgtattctagcattgatcttgtgagagtggggaagtccttaatctttttgggacctcactttcctcatctgtaaaatggcaggtgaggaagctggcacaggaggtatctgtgccttctccatgctctaaacttttacaattctgtgtgttccctactttcctttttctgaaagtataaatctgtatgcagagatgaattttgtgtccccttacctctgtctgacaagtgggctggacattctctccctttctgggcacccattaaataaacagatggttggcctagtccacctggcatcagatattttcagatacaaaaatatagcctctctgggttttaaaaagggagctattaagaccagccgtgcagcttgagaaggactcagtgaggatgctacaggtcatactataactagatttgctgaacatttaaattaaatgattttactaactacagatgtctgacattttgcctctaggtgaactttatgacactgagttgagttccagtggtcctttctcttccctaaggaattattatttgtccttcagccaagaggggctgttgacattcattttatcatgtcttctgtctgcttaggttgccccctccttgtctccagtgatctctcagaatgaatcagctctcacctcaggcagggtttctgcccctgctgagcatgtaaagcgtggacttgcagactcccctggcagatttcaagggcattgcacctggtcctcataagctcccagtgtctccctcccctccggcctgttttgctctttttcttattctctgcacactgggtgcaccttctcatcaccactgcttctgcagagcctcctccaagctctcaaactctatatctctcactgcttacaaccacacagagtttgcaagatttcaaacacttttcctctggtgtagacattatcattgtggatttctgcacaatgagatagttttcccatttggaaaagaaaaagctgatctcagaaagataagcaccctcggggtgcactactggtgcttttctcttggcataccctggtaacaagattaaagtgcattgctatagactgaatgtttttgccctcctcccaaattatgtgttgaaatctaatccccaatatgatagtattaggagatgggacctttgggaggtgattgggtcatgaggacaaaactttcgtgaatgggattagcgccttataaaagaggccccagagaactcccttgtccctttcaccatgtgaggacacagcaagaagaccctgtttgtgaaccagaaagtgggcccttgccagacagcaaatctgccagtgttttgatcttggacttcccagcttctgggactgtgagaaacaaaattctgttgtttttatgccacacagtctatggtattctgttacagtagcccaaacagacttagacacacacaaaaaagtcattctttcaattagagccacggcgggaaacagagggcccacttgaaggagtatttcagaagtcattaataaccagcgcatttctcagggagtgggcagtgttagaaatagtaataaggcatggtgagccctgcagggctgacggcagggtgaagccacgcaaaaaaaaaaaaaaaaaaaatggctaaaggggactgcagcctatgagagctgaagcatggatggggctacctgacaggacctctggctgtagggagagcagccacatccaggcagtggcccaacggggagggaacagggtaatgaaatcccacccctctctgcttctgccccatgacagcctgctggatggagcctcttcctgtgtggctgaaaccaacaggaagctggaaggcaaaggggtccagagatgcatccctagagattgccctcctagggcacaaagcaggatgcagtgtgtggaaatggatcgggggatggaaaaggagataatttggtaaattcactgctgtttttaaaactgtgcttctcattttttttactttgacatttgatactttgctgtatccaagatttctgaaaactcatagtagtaagtaagaaatctaaacagagtcctacttctctttcctttttttctttttcttccttttttttttttgagatggagtttcgctctttcctatttcaacaaatcttgcatggtttcctgcagtatggcttattcaacagtcttgtattttaaagaggggtttatttgagaaagggaagtctatagctattttcaaagtttaaagaaatttctacctgctaactgagagtattctctattaacaatgaattattatgcttactctagcggttgcttggtttataaaatgccttgagcttcctagagaaatgattctccttgaatgcaaagtcctttgtatgcaatgaaataatgacacatagtatctataatttcagaacatatgcttattgttacaaatatctatcttagacatttatattctagaattatctctggccaaaaagatatgaaattattcatctagataagtttcaggacagccatctaggtaaaaacagccttggctctggtatgtctctcctaacctttctctctctctctcctttctccctccctctccatgcctctactctgctccttctctcttctcctttctggataaaaggtgaacttttgataaaaaagacattagtgtatgaattcaagcatcctagataatatgtgttttaatattttcttggattagtttataaacttaattttatctggagcaaaattttttttcaaattgttgatttggaaggcttcataccattagatttcattttatttacaggcttgtttaaatttagttgttgatttacttttgttttactttgttttctctcagttggtccttttctttgtaactatcttttcttatttggcagtctcatgttggcttctttgtggtctccagtcctctggattctagtgcaaagctaggtcgtagcatcgcattctgaggatcttatcttactgaaatattaggaatattgcaaatgcaatccccaagccagtggctatccactttaagagaagcttctgaatctaggggagtgagtggccaaaggtaattgactcattacctgaaaatgggttgtgccaatctaaactgctaccagccacagcatttaaaagctgttttcaatttcaaaattgataggaccaaaggcattttaatgaaaattgttttagtttaagaataaattggggtaataagttgaaatcttaaattacttacatggtttaatataaactggagaaagctgctattctatgtccattcatttttcttccccaaagacaattgtctacaattgtcattaactaaaacatattgcatttcttttagattttggggagatcttaaactatataggcttaccaaagtctatacatataaattcattgctttaccttctaaaccagaggagtttgatatgggaggtctcttccaactgcaacctcagtagtttttatttctataatatatatcctgaaattatctggaattttgagttagtgaaacggtttcaagttatgatactaagaatatatggcaatatatacagctactgagtctcttcgagggaagtagtagatatttttattctccagttataaaacatcccagctgcttgagcattgaatgctattctattttcaaaaccttttatatctcaacagtagaatatatcccagttgttacttctgaataatgactgggttggtggtattgaggagctataaaccgccttctctttctcagcccctgatttaagaacttgtcagactgaaatacagtgggatacttggatgagaggggaagcgggagatacgagtggagactttaaagacagagtggcaaaaggcatgaaattagaaattctatatttcattgacctactgccatacacacatttttcagctaattctttgtggttttaatcaatagatttcatttttactccctatctactgccatccccttca

SEQ ID NO: 815 - DNA, 7310 bp, Homo sapiens
agcaagattcctcaaaatgtctaatatttgcatacctctcttctctattttcagtgctgatgaaaagttttccttgcttttcatctttagtcttttcattttttttgaattgggagggagaggaatcaaccatgtcttcttaagctgctatctttttctaaaagtataaaaatcattattttatttatttatttttatttttatttttatttttgagacagagttttgctcttgttgcccaggctggagtgcaatggcgcgatcttggctcaccacaacctctgcctcccggattcaagtgattctcctacctcagcctcccgagtagcttggattacaggcatgcgccaccatgcccagctaatttcgtatttttggtagagacagggtttctccatgttggtcaggctggtctcgaactcccgacctcaggtaatctgcccaccttggcctcccaaagtgctgggattataggcgtgagccactgcgccaggcctaaaaatcattatttcaaaaagatgactttgaagattatgagattgttcatgacatattatttggaaacaataggttacaaagaatgtgttatgatgcatttcagtttaaagtatattactttaaaatggtaggaataattttagtaagattctatagtcagatcccagttaaactcctgattctgcctttccatcagttttttttttttttttttttttccgagacggagtcttgctttgtcacccaggctggagtgcagtggcacgatctcggttcactgcaagctccgcctcccgggttcacgccattctcctgcctcagcctctctgagtagctgggactacaggcgcctgccaccacgcccggctaattttttgtatttttagttagagacggagtttcaccatggtcttgatctcctgacctcgtgatccgcccaccttggcctcccaaagtgctgggattacaagcgtgagccacggcgccgagcctccatcagttttatgttggacaatttagcctttctaaacctttttctcatctttaaaggggggatacaatcacttttgtaagtttatttcaagtgaggagctatcaggcacagtgcctggcgcatcccaggccttctctacttgtacactgagtaggaaagcacaaggcagtcttaatgcttggcttgctctgtagtttattcaatttttgcttttttgtgacacattctagggagtcttagattaaatttagtcatactattatccaggcttggtggctcacacctgtaatcccagcactttaggaggccgaggcgggtcggccacctgaggtcaggggttcgagaccagcctggccaacatggtgaaaccccatttctactaaaaatacaaaaattatcagggtgtggtggcacatgcctgtaatcccagctactcaggaggctgagacagaagaattgcttgaaccttggaggtggaggttgcagtgagccaagatcacaccactgcactccagcctgggcaacagagggagactccgactcaaaaaaaaaaaaaaaaaaaagtaggtgtattatttaatctattttctaggtctagaaaagcaaaggcgcttcaatatttagatacctactttctaaatcattatgtgtatgtgtgtgtgtacacttgtgtgtgtttgtgtgtctgtgtttactatttcagtcaaatgctgtatcatcaaagttagttgtatgtgtgaaagagaaactttggattctaggtggacaacccactagatctttgagaaaatatctataaatggagaataagaacattagttactgttttgcaggctggaaatgtggccccattccctctctaatcttctgctaagccaggcaggacttcaagatcaaggcctaggtaaaaagtaggcctcccaggtactttaccctcagggtcacactttgattttaccctaggaagggtaaataaaaagaaagggaaaccaagagaaaaagagccctttatctataaatcctgaccaagagtttctcctcggctgaactttagtcatgctcctctgacggtcctctgcactaggccttggccctgtccttgctgggcctgcatagcccagtttcagtgagaatcctgctcagtgactgtagtgataccctcacacccttgatagctggcttcttcatcctccacccacagtgtctaagtccttgggttgcctttagcaacaatcctattaagtttgtttagcaagaatcctcttatctgctcttagtaattttccatccattgaccccctcactctgctccttggctaaaaattcccacttgtccttgttggattgagggttgagcccaacctctctccccaactcccagactccattgcagcagttccccagaataaagtctgtcttactgttctttagcacaggtcagaataattttttcttttttttcttgttttttgagacagagtcttgctttgttgcccaggctggagtgcagtggtgcagtctcagctcactgcaacctctgcctcctgggttcaagtgattctcttgcctcagcctcctgagtagctgggattacagacacacgcaaccaagcctggctaatttttgtatttttagtagagatggggtttccccatgttggccaggctgctctcgaactcctgacctcaggtgatccacccgcctcagcctcctaaagtgttgggattacagatgtgagccaccacacctggcctgaataattttttctttaacaaccctgacaaatccaccccaggctatctcagggctacctcagagaaccaccttttttttttttttttttttttgagatggagtctcactctgtcgcccaggctggagtgcagtgtcacagtctcagctcactgcaacctccgcctcctgggtcaagtgattcttctgcctcagcttctcaaatagctgggattacagccgcacgccaccatgcctggctaatttttgtatttttgtagagatgggatttcaccatggtggtcaggctggtcttgaactcctgaccgcaggtgatccacccgcctcagcctcccaaagtgctgaaattataggcgtgagccactgcacctggccagagaaccactttttaaaatccaaagatttatttaatcttatttatgtatttaaagacagggtctctttttgtcgcccaggctggagtgcagtggtgcgatctgggctcactgcaacctctaccttccgggttcaagtcatcctcctgcctcaacctcctgagtagctgggattacaggcgcccaccaccgcgcctggctaatttttgtatttttagtagagatggggtttcaccattttggccaggctggtctcgaactcctgacctcaagtgatctgccctcctcggcctcccaaggtgctggcatttcaggcgtgagccactgcgtccggccaaaatccaaagatttaaataggaacaagcaggaaaggaaagtccatgggtgagcaaatgcttccaatctcttaggtccttacattcttgttaaacttcacccttagcaataattaagccccaaagtctccttgacgtgtatatttttttcccacagcaaaggcgttagtgtgaggaaatccttgtgctccccctagaggttagagggcgcatccagcacgtcctggcaaagtgtgtgtggatggcgcagggtgggtggggtggggggatgcttgttgttttactattaaagtcaggaaatcaagggttttgcattctctctccagggagctttgcagagtaccagaaatgtcttgtctgcaccttcatgcggtttatttttcagtctttgcttgttctccacctgggactcatgaaatcggtagttctgcccctttacaagtgttcctttgatgtaatacccagggagccagagaactaggtcaggacattctatcaagtacaatccaagtatttttccaagtggaccacctgcataaaaatatcctgaagagtttgtttaagatgaagaattctgggccccaccccacaaccttctgaattggcatttctggaggtgaggcaattcttatgcacattaaggtttaagaaccactgctgtaccctacttgagaaggaatttctcccttctatatcttgtttaaaattatgctgtaggatgctataatcaaacccatcagacagggttacagatctaatgagcccaatagaaagataacataagatgctagtctttcactctgaaaacagaacccagcgggcaaatcacaaggtcacgagtttgagaccagcctggccaacattgtgaaaccctgtctctactaaaaatacaaaaaattatctgggcatactggcgggcacctgtaatcccagctacttgggaggctaaggcaggagaatcactcgaacctgggaagcagaggttgcagtgagctgagatcgcaccactgcattccagcctgggtggcagagcgagactctgtctcaaacaaaaacaaaaacaacaaaaaactcttcccaattcaatcccgtgaatctaaatcctcaaatatgtagaaaatgcttgtctctttttttttcctttttaaaaaaatttctcccatttttaaaatgttttcattgttgtgggtacttagtaggtatatattgggttacatgagaatttttttaaattttattattattatactttaagttttagggtacatgtgcacaatgtgcaggtttgttacatatgtatacatgtgccatgttggtatgctgcacccattaactcgtcatttaacattaggtatatctcctgatgctatccctcccccctccccccatcccacaacagtccccggagtgtgatgttccccttcctgtgtccatgtgttctcattgttcaattcccacctatgagtgagaatgttgcccaggctggagtgcagtggcgtgatcttggctcactgcaacctctcctcccaagtagctgggactatgggcagtgccaccacgcctggctaatttatgtgtttttaggagagacagggctttgccatgttggccaggctggcctcaagtgatccacctgcctgggcctcccaaagtgctgggattacaggcgtgagccaccgcaccaggcctaaaaattattattttaaaaagatgaccgtgcccagcctacatgagatgttttgatacaggcatgcaatgcataataatcacatcagggtaaattaagtattcgtcacctcaagcctttatcctttgtgttacaaacaatccaattatactcttttagttttttagattttattttattttttgagatggagtctcactgtgtcgcctgggctgcctgcaacctccgcctcctgggttcaagtgattctcatgcctcagtctcccgggtagctgggatcacaggcatgctccaccacacctggctaacttttctatttttagtagagacagggtttcgacacgttggcaagtctggtctcaaactcctgacctcaagccatacacccgccttccaaagtgctgggattacaggcgtaagccatcatgcccagcctcttttagttatttttaaatgtacaattaaattattttggggctgggtgcaggggctcatgcctgtaatcctagcagtttgggaggccaaggcagaaggatcacttgagcccaggagctcgagaccagcctgggcaacgtagcaagacctcgtctctacaaaaaaataaacacaattagctggatgtggtggtgtgtgcctgtagtcccagctacttgggaagctaaggtgggaggatcacttgagcccaggaggtagaggctgcagtgagctatgatcacacaccactccactccagcctgggtgacagagtgagaccctgttgaaatatatatatatatatatatttttttttttttttttaccatagtcatcctgttgtgccagcaaattctagctcatttattctttctaaacttttttttttttttgagatggagtttcactcttgtccaggctagactgcaaatggcatgatctcggctcactgcaatctccacctcccaggtttgagcgattctcctgcctcagcctcccaagtagctgggattacaggcacctgccaccacaccagctaatttttttttttttttttttttttggtatttttagtagagacagggtttcaccatgttggccaggctggtcttgaactcctgacctcaggtgatccaccctcctcgtcctcccagtgctaggattacaggcatgagccactgtgccctacgctttctaaacatttttgtaccccttaaccatcatctctttccctctgcccaccaaccctccagcctctggtaaccatccttctactctctatgtccatgagttcaattgtgttgatttttagatcccacaattggtccctgatgccttatttagttcatttggggaggtcacattttcctggatggtcttgatgtttatgggtgttcatttgtgtctgggcccaaaactattatttattgtagttttcacagtctgggcttgtttatacctgtccttcttggaaaggctttctaggtacttagaaggacttgagtgttgtaatctaagctgccttaggggacaccccaaacccagtaatgctgtggctcttgcagactcgtagaggtaccgccttgatgttcttggatgagatctggaagaattctctggattaccagcacagacacttctcttcccttaccttctcccaaagagacagagtcaatctctctctctctctctctctctctctctctctctctctctctgttctgagccacctggagctaaggatggggtgacacaagcactcctgtggctactaccactaggactactctgggtcggacctgaagccagtacagaactgggtctcacctaagacccactgtaactacgacttggctactgcctgtgttcactcaaggcccttgagttctacaatcagcaggtggcaggtccagccaggcctgtgtccttcccttcaggacggcaagttcccccaggccctggacaggtccagaggtgtcatccaagagcccggacctggaataaaaatccttagaagcctacctgatgttctattgtactgcagctgagctggctttcaaaccatgagatgccgtctttccaactctttcctctcctttccacagtcggaggagtctcacccagtggccactactaccacaggcccatggggagtactgccaggctattaaggcccaagggctcttaagctcactgta

SEQ ID NO: 816 - DNA, 11843 bp, Homo sapiens
agcaagattcctcaaaatgtctaatatttgcatacctctcttctctattttcagtgctgatgaaaagttttccttgcttttcatctttagtcttttcattttttttgaattgggagggagaggaatcaaccatgtcttcttaagctgctatctttttctaaaagtataaaaatcattattttatttatttatttttatttttatttttatttttgagacagagttttgctcttgttgcccaggctggagtgcaatggcgcgatcttggctcaccacaacctctgcctcccggattcaagtgattctcctacctcagcctcccgagtagcttggattacaggcatgcgccaccatgcccagctaatttcgtatttttggtagagacagggtttctccatgttggtcaggctggtctcgaactcccgacctcaggtaatctgcccaccttggcctcccaaagtgctgggattataggcgtgagccactgcgccaggcctaaaaatcattatttcaaaaagatgactttgaagattatgagattgttcatgacatattatttggaaacaataggttacaaagaatgtgttatgatgcatttcagtttaaagtatattactttaaaatggtaggaataattttagtaagattctatagtcagatcccagttaaactcctgattctgcctttccatcagttttttttttttttttttttttccgagacggagtcttgctttgtcacccaggctggagtgcagtggcacgatctcggttcactgcaagctccgcctcccgggttcacgccattctcctgcctcagcctctctgagtagctgggactacaggcgcctgccaccacgcccggctaattttttgtatttttagttagagacggagtttcaccatggtcttgatctcctgacctcgtgatccgcccaccttggcctcccaaagtgctgggattacaagcgtgagccacggcgccgagcctccatcagttttatgttggacaatttagcctttctaaacctttttctcatctttaaaggggggatacaatcacttttgtaagtttatttcaagtgaggagctatcaggcacagtgcctggcgcatcccaggccttctctacttgtacactgagtaggaaagcacaaggcagtcttaatgcttggcttgctctgtagtttattcaatttttgcttttttgtgacacattctagggagtcttagattaaatttagtcatactattatccaggcttggtggctcacacctgtaatcccagcactttaggaggccgaggcgggtcggccacctgaggtcaggggttcgagaccagcctggccaacatggtgaaaccccatttctactaaaaatacaaaaattatcagggtgtggtggcacatgcctgtaatcccagctactcaggaggctgagacagaagaattgcttgaaccttggaggtggaggttgcagtgagccaagatcacaccactgcactccagcctgggcaacagagggagactccgactcaaaaaaaaaaaaaaaaaaaagtaggtgtattatttaatctattttctaggtctagaaaagcaaaggcgcttcaatatttagatacctactttctaaatcattatgtgtatgtgtgtgtgtacacttgtgtgtgtttgtgtgtctgtgtttactatttcagtcaaatgctgtatcatcaaagttagttgtatgtgtgaaagagaaactttggattctaggtggacaacccactagatctttgagaaaatatctataaatggagaataagaacattagttactgttttgcaggctggaaatgtggccccattccctctctaatcttctgctaagccaggcaggacttcaagatcaaggcctaggtaaaaagtaggcctcccaggtactttaccctcagggtcacactttgattttaccctaggaagggtaaataaaaagaaagggaaaccaagagaaaaagagccctttatctataaatcctgaccaagagtttctcctcggctgaactttagtcatgctcctctgacggtcctctgcactaggccttggccctgtccttgctgggcctgcatagcccagtttcagtgagaatcctgctcagtgactgtagtgataccctcacacccttgatagctggcttcttcatcctccacccacagtgtctaagtccttgggttgcctttagcaacaatcctattaagtttgtttagcaagaatcctcttatctgctcttagtaattttccatccattgaccccctcactctgctccttggctaaaaattcccacttgtccttgttggattgagggttgagcccaacctctctccccaactcccagactccattgcagcagttccccagaataaagtctgtcttactgttctttagcacaggtcagaataattttttcttttttttcttgttttttgagacagagtcttgctttgttgcccaggctggagtgcagtggtgcagtctcagctcactgcaacctctgcctcctgggttcaagtgattctcttgcctcagcctcctgagtagctgggattacagacacacgcaaccaagcctggctaatttttgtatttttagtagagatggggtttccccatgttggccaggctgctctcgaactcctgacctcaggtgatccacccgcctcagcctcctaaagtgttgggattacagatgtgagccaccacacctggcctgaataattttttctttaacaaccctgacaaatccaccccaggctatctcagggctacctcagagaaccaccttttttttttttttttttttttgagatggagtctcactctgtcgcccaggctggagtgcagtgtcacagtctcagctcactgcaacctccgcctcctgggtcaagtgattcttctgcctcagcttctcaaatagctgggattacagccgcacgccaccatgcctggctaatttttgtatttttgtagagatgggatttcaccatggtggtcaggctggtcttgaactcctgaccgcaggtgatccacccgcctcagcctcccaaagtgctgaaattataggcgtgagccactgcacctggccagagaaccactttttaaaatccaaagatttatttaatcttatttatgtatttaaagacagggtctctttttgtcgcccaggctggagtgcagtggtgcgatctgggctcactgcaacctctaccttccgggttcaagtcatcctcctgcctcaacctcctgagtagctgggattacaggcgcccaccaccgcgcctggctaatttttgtatttttagtagagatggggtttcaccattttggccaggctggtctcgaactcctgacctcaagtgatctgccctcctcggcctcccaaggtgctggcatttcaggcgtgagccactgcgtccggccaaaatccaaagatttaaataggaacaagcaggaaaggaaagtccatgggtgagcaaatgcttccaatctcttaggtccttacattcttgttaaacttcacccttagcaataattaagccccaaagtctccttgacgtgtatatttttttcccacagcaaaggcgttagtgtgaggaaatccttgtgctccccctagaggttagagggcgcatccagcacgtcctggcaaagtgtgtgtggatggcgcagggtgggtggggtggggggatgcttgttgttttactattaaagtcaggaaatcaagggttttgcattctctctccagggagctttgcagagtaccagaaatgtcttgtctgcaccttcatgcggtttatttttcagtctttgcttgttctccacctgggactcatgaaatcggtagttctgcccctttacaagtgttcctttgatgtaatacccagggagccagagaactaggtcaggacattctatcaagtacaatccaagtatttttccaagtggaccacctgcataaaaatatcctgaagagtttgtttaagatgaagaattctgggccccaccccacaaccttctgaattggcatttctggaggtgaggcaattcttatgcacattaaggtttaagaaccactgctgtaccctacttgagaaggaatttctcccttctatatcttgtttaaaattatgctgtaggatgctataatcaaacccatcagacagggttacagatctaatgagcccaatagaaagataacataagatgctagtctttcactctgaaaacagaacccagcgggcaaatcacaaggtcacgagtttgagaccagcctggccaacattgtgaaaccctgtctctactaaaaatacaaaaaattatctgggcatactggcgggcacctgtaatcccagctacttgggaggctaaggcaggagaatcactcgaacctgggaagcagaggttgcagtgagctgagatcgcaccactgcattccagcctgggtggcagagcgagactctgtctcaaacaaaaacaaaaacaacaaaaaactcttcccaattcaatcccgtgaatctaaatcctcaaatatgtagaaaatgcttgtctctttttttttcctttttaaaaaaatttctcccatttttaaaatgttttcattgttgtgggtacttagtaggtatatattgggttacatgagaatttttttaaattttattattattatactttaagttttagggtacatgtgcacaatgtgcaggtttgttacatatgtatacatgtgccatgttggtatgctgcacccattaactcgtcatttaacattaggtatatctcctgatgctatccctcccccctccccccatcccacaacagtccccggagtgtgatgttccccttcctgtgtccatgtgttctcattgttcaattcccacctatgagtgagaatgttgcccaggctggagtgcagtggcgtgatcttggctcactgcaacctctcctcccaagtagctgggactatgggcagtgccaccacgcctggctaatttatgtgtttttaggagagacagggctttgccatgttggccaggctggcctcaagtgatccacctgcctgggcctcccaaagtgctgggattacaggcgtgagccaccgcaccaggcctaaaaattattattttaaaaagatgaccgtgcccagcctacatgagatgttttgatacaggcatgcaatgcataataatcacatcagggtaaattaagtattcgtcacctcaagcctttatcctttgtgttacaaacaatccaattatactcttttagttttttagattttattttattttttgagatggagtctcactgtgtcgcctgggctgcctgcaacctccgcctcctgggttcaagtgattctcatgcctcagtctcccgggtagctgggatcacaggcatgctccaccacacctggctaacttttctatttttagtagagacagggtttcgacacgttggcaagtctggtctcaaactcctgacctcaagccatacacccgccttccaaagtgctgggattacaggcgtaagccatcatgcccagcctcttttagttatttttaaatgtacaattaaattattttggggctgggtgcaggggctcatgcctgtaatcctagcagtttgggaggccaaggcagaaggatcacttgagcccaggagctcgagaccagcctgggcaacgtagcaagacctcgtctctacaaaaaaataaacacaattagctggatgtggtggtgtgtgcctgtagtcccagctacttgggaagctaaggtgggaggatcacttgagcccaggaggtagaggctgcagtgagctatgatcacacaccactccactccagcctgggtgacagagtgagaccctgttgaaatatatatatatatatatatttttttttttttttttaccatagtcatcctgttgtgccagcaaattctagctcatttattctttctaaacttttttttttttttgagatggagtttcactcttgtccaggctagactgcaaatggcatgatctcggctcactgcaatctccacctcccaggtttgagcgattctcctgcctcagcctcccaagtagctgggattacaggcacctgccaccacaccagctaatttttttttttttttttttttttggtatttttagtagagacagggtttcaccatgttggccaggctggtcttgaactcctgacctcaggtgatccaccctcctcgtcctcccagtgctaggattacaggcatgagccactgtgccctacgctttctaaacatttttgtaccccttaaccatcatctctttccctctgcccaccaaccctccagcctctggtaaccatccttctactctctatgtccatgagttcaattgtgttgatttttagatcccacaattggtccctgatgccttatttagttcatttggggaggtcacattttcctggatggtcttgatgtttatgggtgttcatttgtgtctgggcccaaaactattatttattgtagttttcacagtctgggcttgtttatacctgtccttcttggaaaggctttctaggtacttagaaggacttgagtgttgtaatctaagctgccttaggggacaccccaaacccagtaatgctgtggctcttgcagactcgtagaggtaccgccttgatgttcttggatgagatctggaagaattctctggattaccagcacagacacttctcttcccttaccttctcccaaagagacagagtcaatctctctctctctctctctctctctctctctctctctctctctgttctgagccacctggagctaaggatggggtgacacaagcactcctgtggctactaccactaggactactctgggtcggacctgaagccagtacagaactgggtctcacctaagacccactgtaactacgacttggctactgcctgtgttcactcaaggcccttgagttctacaatcagcaggtggcaggtccagccaggcctgtgtccttcccttcaggacggcaagttcccccaggccctggacaggtccagaggtgtcatccaagagcccggacctggaataaaaatccttagaagcctacctgatgttctattgtactgcagctgagctggctttcaaaccatgagatgccgtctttccaactctttcctctcctttccacagtcggaggagtctcacccagtggccactactaccacaggcccatggggagtactgccaggctattaaggcccaagggctcttaagctcactgtacctggctataagttttatttaacactgttgttcatggaagacatttgctgctcttttcggatcagcccaaactgggccttagaatgtgtcatagggccgagtggagtggcttatgcctgcaaccccagcactttgaggcgctgaggtgggtggattgcttgagtccaggagttcaagaccagcgtgggcaacatggtgaaactccatctctacaaaaaaatacaaaaattaaatacaaagattagccgggcatggtggcatgtgcctgtggtcccagctactttcctggctgaggggggagaatcacctaagcccaggaggtcaaggctgcaacctaggccacagtcttgaactcctggcctcaagtgcccacctcagcctcccaaagtgctggaaatacaggagtgagccaccgcgcccggcctggtctctttttttctatctctctatttattatttctctctaaatccctctaaactctgttcattactatttctatttctattcctgtgtaagtctcctggtgatgaattatcttcgcttttgttcataccaaagtgtcttaatttgccttcattctttttcccaatgtttttattatggtaaactacacaaacataaaatttaccatcttaaatgttttaaagtgtgcagttcagtagggtttttttgttttgttttcttgagatggcctctcactctattgcccaggctggagtgcaggggcatgatcttggctcactgcaaccttcccctcccaggtttaagcaattctcttgtttcagtctcctgagtagctgggattacaggtgcccaccaccacacctagctaacttttgtatttttagtagtattaagtacattccaattattgggcaaccattgtaatcacccagtgggttcttcctgcctgctgcacaggcaaaatcaatccactgagaccatggcattgcagtaaagaaagcatgtaactgatgcaaggctagctatgccatgagcgagacagagttattagtcaaatcaatctcccagaagtctcagaggctagggtttttcaaggagtttggtgagcagggggctagggaagggggcattctgattggttggggatgccatcacagggtgtggaaaacagtccagtcctggtgtgatgagtcggcttctgggggaggaccactagaggtgtcgctggtctgggtggggccatccagtagccagaaatgcaaaagcctggccatgcaggaattacacgtataattccagcactttgggaggctgaggcaggagaatcacttgaggtcaggagttcgagaccaacctggccgacatggtgaaaccccatctctactaaaaacacaaaaattagctgggcgtgctggtgcatgcctgtaatcccagctactcaggagggtaagatgtaagaattgcttgaacccaggaggtggaggtcacaatgaactgagatcacgccactccactctagccagagtgcgactctgtctcaaaagaaagaaaaaagaaatgcagaaacctgaaaagatatctcaaaaggccaatcttaggttcacaatagtgatgatatttacaggagtaattgaggaagttacacatcttgggacctccggagtaatggctggtaatcatttaactatgcacataacttagcagaattcaggaccctcttaccctcctaacttggtggtctttcattagttttacaagggaggtttagttttgggggaagggctactatcatttaagctataaactaaatttctcccaaacttagcttggcctacacccaggaatatgcaaagatagccagcctatgaggctaaaagcaagatggagtcagccatgtcagatttctcttactgtcataattttgcaaaggcagtttcaccatcaccaccatccatcaccagaactcttttcatgttgcaaaaactctatatccactaaacaataactctcatttctcctcccaccagctcctagcaaccatgattctactttctaagattttgactatgctaagtacctcatacaaatggaagtatacaatatttgtctttctgtgactggcttaattagcataatgtcttcaagttttatctgtgttgtagcatgtgtcagaacttccttcttttttaaggctgaataatattccattttatgtatacataacattttgcttatccatttatctgcaacttgagttgcttccaccttagagctattgtgaataatgctggcatgaacatgggtgtacaaatacctcttcaagaccctactttctttttttttttttttttggagatggagtctcgctctgttgcccaggctggagtgcaatggcgcgatctcggctcaccataacctctgcctcccgggttcaagcgattctcctgcctcagcctcccaagtagccgggactacaggcacgtgccaccatgcccggctaatttttgtatttttagtaaagattgggtttcactctgttggccaggctggtctcgaacacctgacctcatgatccacttgcctcggcctcccaaaatgctgcgattacaggtgtgagccaccttgcctggccaagaccctactttcaattcttttgagaatatacccaaaagtgaaattgatgaatcatatgcaaattacatttttaatttttaatttttttttgagatggagtcttgctctatcaccaaggctggagtacagtggcatgatcttggctcactgcaacctccacctcccaggttcaagaaattcttgtgcctcagcctcccgagtagctgggattataggcatgtgccatcatgcccagctaatttttgtatttttggtagagatggggttttgccatgttggccaggctggacttgaactcctggcctcaagtgatcggcccacctcagcctcccaaagtgttggcattacaggcatgagccaccgtgcccagccccatttttaatttttgaggaaccaccgtaactgttttctgcagcagcttcaccatttcacattcccaccaacagtgcacaaggattccaatttctccacatcctcgacaatgcttgctattttctggagtttatttatttatatagttttaaaaatgagatggagtttagccatgttgttcaggctggtctcaaactcctgagctcaagggatctgcctgctgcagcctcccaaaatgctaggattactggcttgagccactatgtccaatcctggagtttgttttgtttagagtagccatcctaatagtgtgaagtggtatctcactgtagttttgatttgcaatcccctaatgattagtgatgttcccctccttttcttttcattttgccttctttttttttttttttttgagacggagtcttgctgtgtcgctcaggctggactgcagtggcgctatcttggctcactgaaacctctgtctcccgggttcaagtgattctcctgcctcagcctcccgagtagctgggattacaggcacctgccaccatgcccagctaatttttatatttttagtatagacggggtttcaccatgttggccaggctggtctcaaactcctgacctcaggtgatccacctgcctcggcctcctaaagtgctgggttacaggcgtgagctaccacacccggctgccttcattcttaaaggatgttttgctggctatagaattctggattgatttacttttttctgatcctatacttgaagatattgtttcactgtcttctgatatctattatttataagaagaaacagcattcatttgtatcatcattccctgcatatagtgagttgttttctctggctttcaagattttctctttatctttggttttcagcattttgactatactgtgtgcaggtatggttttcttcatatttttttttttggtggggagagggttacttagcttcttaaatctataaatttatctttcaacctatttagaaaatttcaacctctttttcttcaaaataatttttctgtcccatattctcttccttacttctgagactccagttacacatattttagctcttttgctatttcccctcagtttcctgagagtctattcattcccgccctctcccatccattttctgtctgttacttagattgagtaatttttattgatttctcatcaagttttctgacttttttctcctgtcaccttcaatctgcttctaagcctgtccagtaaagctttaaatttcagatattaaacttttcaattgtataatttacatttggttactatagtttttatttctctgcttgtattttctttcattaattatgagtaatattttcctttatatatgtactctgtttggcacaattttaatagctgctttaaagtctttgttataactcaacatttgatgcatgtcagcatcagactcttgagtactggggtcacatttcatttttatgtctagtaatttcagattgtaccttggatattgtaaaagataccttgtagaagttttggattctgt

SEQ ID NO: 817 - DNA, 15780 bp, Homo sapiens
agcaagattcctcaaaatgtctaatatttgcatacctctcttctctattttcagtgctgatgaaaagttttccttgcttttcatctttagtcttttcattttttttgaattgggagggagaggaatcaaccatgtcttcttaagctgctatctttttctaaaagtataaaaatcattattttatttatttatttttatttttatttttatttttgagacagagttttgctcttgttgcccaggctggagtgcaatggcgcgatcttggctcaccacaacctctgcctcccggattcaagtgattctcctacctcagcctcccgagtagcttggattacaggcatgcgccaccatgcccagctaatttcgtatttttggtagagacagggtttctccatgttggtcaggctggtctcgaactcccgacctcaggtaatctgcccaccttggcctcccaaagtgctgggattataggcgtgagccactgcgccaggcctaaaaatcattatttcaaaaagatgactttgaagattatgagattgttcatgacatattatttggaaacaataggttacaaagaatgtgttatgatgcatttcagtttaaagtatattactttaaaatggtaggaataattttagtaagattctatagtcagatcccagttaaactcctgattctgcctttccatcagttttttttttttttttttttttccgagacggagtcttgctttgtcacccaggctggagtgcagtggcacgatctcggttcactgcaagctccgcctcccgggttcacgccattctcctgcctcagcctctctgagtagctgggactacaggcgcctgccaccacgcccggctaattttttgtatttttagttagagacggagtttcaccatggtcttgatctcctgacctcgtgatccgcccaccttggcctcccaaagtgctgggattacaagcgtgagccacggcgccgagcctccatcagttttatgttggacaatttagcctttctaaacctttttctcatctttaaaggggggatacaatcacttttgtaagtttatttcaagtgaggagctatcaggcacagtgcctggcgcatcccaggccttctctacttgtacactgagtaggaaagcacaaggcagtcttaatgcttggcttgctctgtagtttattcaatttttgcttttttgtgacacattctagggagtcttagattaaatttagtcatactattatccaggcttggtggctcacacctgtaatcccagcactttaggaggccgaggcgggtcggccacctgaggtcaggggttcgagaccagcctggccaacatggtgaaaccccatttctactaaaaatacaaaaattatcagggtgtggtggcacatgcctgtaatcccagctactcaggaggctgagacagaagaattgcttgaaccttggaggtggaggttgcagtgagccaagatcacaccactgcactccagcctgggcaacagagggagactccgactcaaaaaaaaaaaaaaaaaaaagtaggtgtattatttaatctattttctaggtctagaaaagcaaaggcgcttcaatatttagatacctactttctaaatcattatgtgtatgtgtgtgtgtacacttgtgtgtgtttgtgtgtctgtgtttactatttcagtcaaatgctgtatcatcaaagttagttgtatgtgtgaaagagaaactttggattctaggtggacaacccactagatctttgagaaaatatctataaatggagaataagaacattagttactgttttgcaggctggaaatgtggccccattccctctctaatcttctgctaagccaggcaggacttcaagatcaaggcctaggtaaaaagtaggcctcccaggtactttaccctcagggtcacactttgattttaccctaggaagggtaaataaaaagaaagggaaaccaagagaaaaagagccctttatctataaatcctgaccaagagtttctcctcggctgaactttagtcatgctcctctgacggtcctctgcactaggccttggccctgtccttgctgggcctgcatagcccagtttcagtgagaatcctgctcagtgactgtagtgataccctcacacccttgatagctggcttcttcatcctccacccacagtgtctaagtccttgggttgcctttagcaacaatcctattaagtttgtttagcaagaatcctcttatctgctcttagtaattttccatccattgaccccctcactctgctccttggctaaaaattcccacttgtccttgttggattgagggttgagcccaacctctctccccaactcccagactccattgcagcagttccccagaataaagtctgtcttactgttctttagcacaggtcagaataattttttcttttttttcttgttttttgagacagagtcttgctttgttgcccaggctggagtgcagtggtgcagtctcagctcactgcaacctctgcctcctgggttcaagtgattctcttgcctcagcctcctgagtagctgggattacagacacacgcaaccaagcctggctaatttttgtatttttagtagagatggggtttccccatgttggccaggctgctctcgaactcctgacctcaggtgatccacccgcctcagcctcctaaagtgttgggattacagatgtgagccaccacacctggcctgaataattttttctttaacaaccctgacaaatccaccccaggctatctcagggctacctcagagaaccaccttttttttttttttttttttttgagatggagtctcactctgtcgcccaggctggagtgcagtgtcacagtctcagctcactgcaacctccgcctcctgggtcaagtgattcttctgcctcagcttctcaaatagctgggattacagccgcacgccaccatgcctggctaatttttgtatttttgtagagatgggatttcaccatggtggtcaggctggtcttgaactcctgaccgcaggtgatccacccgcctcagcctcccaaagtgctgaaattataggcgtgagccactgcacctggccagagaaccactttttaaaatccaaagatttatttaatcttatttatgtatttaaagacagggtctctttttgtcgcccaggctggagtgcagtggtgcgatctgggctcactgcaacctctaccttccgggttcaagtcatcctcctgcctcaacctcctgagtagctgggattacaggcgcccaccaccgcgcctggctaatttttgtatttttagtagagatggggtttcaccattttggccaggctggtctcgaactcctgacctcaagtgatctgccctcctcggcctcccaaggtgctggcatttcaggcgtgagccactgcgtccggccaaaatccaaagatttaaataggaacaagcaggaaaggaaagtccatgggtgagcaaatgcttccaatctcttaggtccttacattcttgttaaacttcacccttagcaataattaagccccaaagtctccttgacgtgtatatttttttcccacagcaaaggcgttagtgtgaggaaatccttgtgctccccctagaggttagagggcgcatccagcacgtcctggcaaagtgtgtgtggatggcgcagggtgggtggggtggggggatgcttgttgttttactattaaagtcaggaaatcaagggttttgcattctctctccagggagctttgcagagtaccagaaatgtcttgtctgcaccttcatgcggtttatttttcagtctttgcttgttctccacctgggactcatgaaatcggtagttctgcccctttacaagtgttcctttgatgtaatacccagggagccagagaactaggtcaggacattctatcaagtacaatccaagtatttttccaagtggaccacctgcataaaaatatcctgaagagtttgtttaagatgaagaattctgggccccaccccacaaccttctgaattggcatttctggaggtgaggcaattcttatgcacattaaggtttaagaaccactgctgtaccctacttgagaaggaatttctcccttctatatcttgtttaaaattatgctgtaggatgctataatcaaacccatcagacagggttacagatctaatgagcccaatagaaagataacataagatgctagtctttcactctgaaaacagaacccagcgggcaaatcacaaggtcacgagtttgagaccagcctggccaacattgtgaaaccctgtctctactaaaaatacaaaaaattatctgggcatactggcgggcacctgtaatcccagctacttgggaggctaaggcaggagaatcactcgaacctgggaagcagaggttgcagtgagctgagatcgcaccactgcattccagcctgggtggcagagcgagactctgtctcaaacaaaaacaaaaacaacaaaaaactcttcccaattcaatcccgtgaatctaaatcctcaaatatgtagaaaatgcttgtctctttttttttcctttttaaaaaaatttctcccatttttaaaatgttttcattgttgtgggtacttagtaggtatatattgggttacatgagaatttttttaaattttattattattatactttaagttttagggtacatgtgcacaatgtgcaggtttgttacatatgtatacatgtgccatgttggtatgctgcacccattaactcgtcatttaacattaggtatatctcctgatgctatccctcccccctccccccatcccacaacagtccccggagtgtgatgttccccttcctgtgtccatgtgttctcattgttcaattcccacctatgagtgagaatgttgcccaggctggagtgcagtggcgtgatcttggctcactgcaacctctcctcccaagtagctgggactatgggcagtgccaccacgcctggctaatttatgtgtttttaggagagacagggctttgccatgttggccaggctggcctcaagtgatccacctgcctgggcctcccaaagtgctgggattacaggcgtgagccaccgcaccaggcctaaaaattattattttaaaaagatgaccgtgcccagcctacatgagatgttttgatacaggcatgcaatgcataataatcacatcagggtaaattaagtattcgtcacctcaagcctttatcctttgtgttacaaacaatccaattatactcttttagttttttagattttattttattttttgagatggagtctcactgtgtcgcctgggctgcctgcaacctccgcctcctgggttcaagtgattctcatgcctcagtctcccgggtagctgggatcacaggcatgctccaccacacctggctaacttttctatttttagtagagacagggtttcgacacgttggcaagtctggtctcaaactcctgacctcaagccatacacccgccttccaaagtgctgggattacaggcgtaagccatcatgcccagcctcttttagttatttttaaatgtacaattaaattattttggggctgggtgcaggggctcatgcctgtaatcctagcagtttgggaggccaaggcagaaggatcacttgagcccaggagctcgagaccagcctgggcaacgtagcaagacctcgtctctacaaaaaaataaacacaattagctggatgtggtggtgtgtgcctgtagtcccagctacttgggaagctaaggtgggaggatcacttgagcccaggaggtagaggctgcagtgagctatgatcacacaccactccactccagcctgggtgacagagtgagaccctgttgaaatatatatatatatatatatttttttttttttttttaccatagtcatcctgttgtgccagcaaattctagctcatttattctttctaaacttttttttttttttgagatggagtttcactcttgtccaggctagactgcaaatggcatgatctcggctcactgcaatctccacctcccaggtttgagcgattctcctgcctcagcctcccaagtagctgggattacaggcacctgccaccacaccagctaatttttttttttttttttttttttggtatttttagtagagacagggtttcaccatgttggccaggctggtcttgaactcctgacctcaggtgatccaccctcctcgtcctcccagtgctaggattacaggcatgagccactgtgccctacgctttctaaacatttttgtaccccttaaccatcatctctttccctctgcccaccaaccctccagcctctggtaaccatccttctactctctatgtccatgagttcaattgtgttgatttttagatcccacaattggtccctgatgccttatttagttcatttggggaggtcacattttcctggatggtcttgatgtttatgggtgttcatttgtgtctgggcccaaaactattatttattgtagttttcacagtctgggcttgtttatacctgtccttcttggaaaggctttctaggtacttagaaggacttgagtgttgtaatctaagctgccttaggggacaccccaaacccagtaatgctgtggctcttgcagactcgtagaggtaccgccttgatgttcttggatgagatctggaagaattctctggattaccagcacagacacttctcttcccttaccttctcccaaagagacagagtcaatctctctctctctctctctctctctctctctctctctctctctgttctgagccacctggagctaaggatggggtgacacaagcactcctgtggctactaccactaggactactctgggtcggacctgaagccagtacagaactgggtctcacctaagacccactgtaactacgacttggctactgcctgtgttcactcaaggcccttgagttctacaatcagcaggtggcaggtccagccaggcctgtgtccttcccttcaggacggcaagttcccccaggccctggacaggtccagaggtgtcatccaagagcccggacctggaataaaaatccttagaagcctacctgatgttctattgtactgcagctgagctggctttcaaaccatgagatgccgtctttccaactctttcctctcctttccacagtcggaggagtctcacccagtggccactactaccacaggcccatggggagtactgccaggctattaaggcccaagggctcttaagctcactgtacctggctataagttttatttaacactgttgttcatggaagacatttgctgctcttttcggatcagcccaaactgggccttagaatgtgtcatagggccgagtggagtggcttatgcctgcaaccccagcactttgaggcgctgaggtgggtggattgcttgagtccaggagttcaagaccagcgtgggcaacatggtgaaactccatctctacaaaaaaatacaaaaattaaatacaaagattagccgggcatggtggcatgtgcctgtggtcccagctactttcctggctgaggggggagaatcacctaagcccaggaggtcaaggctgcaacctaggccacagtcttgaactcctggcctcaagtgcccacctcagcctcccaaagtgctggaaatacaggagtgagccaccgcgcccggcctggtctctttttttctatctctctatttattatttctctctaaatccctctaaactctgttcattactatttctatttctattcctgtgtaagtctcctggtgatgaattatcttcgcttttgttcataccaaagtgtcttaatttgccttcattctttttcccaatgtttttattatggtaaactacacaaacataaaatttaccatcttaaatgttttaaagtgtgcagttcagtagggtttttttgttttgttttcttgagatggcctctcactctattgcccaggctggagtgcaggggcatgatcttggctcactgcaaccttcccctcccaggtttaagcaattctcttgtttcagtctcctgagtagctgggattacaggtgcccaccaccacacctagctaacttttgtatttttagtagtattaagtacattccaattattgggcaaccattgtaatcacccagtgggttcttcctgcctgctgcacaggcaaaatcaatccactgagaccatggcattgcagtaaagaaagcatgtaactgatgcaaggctagctatgccatgagcgagacagagttattagtcaaatcaatctcccagaagtctcagaggctagggtttttcaaggagtttggtgagcagggggctagggaagggggcattctgattggttggggatgccatcacagggtgtggaaaacagtccagtcctggtgtgatgagtcggcttctgggggaggaccactagaggtgtcgctggtctgggtggggccatccagtagccagaaatgcaaaagcctggccatgcaggaattacacgtataattccagcactttgggaggctgaggcaggagaatcacttgaggtcaggagttcgagaccaacctggccgacatggtgaaaccccatctctactaaaaacacaaaaattagctgggcgtgctggtgcatgcctgtaatcccagctactcaggagggtaagatgtaagaattgcttgaacccaggaggtggaggtcacaatgaactgagatcacgccactccactctagccagagtgcgactctgtctcaaaagaaagaaaaaagaaatgcagaaacctgaaaagatatctcaaaaggccaatcttaggttcacaatagtgatgatatttacaggagtaattgaggaagttacacatcttgggacctccggagtaatggctggtaatcatttaactatgcacataacttagcagaattcaggaccctcttaccctcctaacttggtggtctttcattagttttacaagggaggtttagttttgggggaagggctactatcatttaagctataaactaaatttctcccaaacttagcttggcctacacccaggaatatgcaaagatagccagcctatgaggctaaaagcaagatggagtcagccatgtcagatttctcttactgtcataattttgcaaaggcagtttcaccatcaccaccatccatcaccagaactcttttcatgttgcaaaaactctatatccactaaacaataactctcatttctcctcccaccagctcctagcaaccatgattctactttctaagattttgactatgctaagtacctcatacaaatggaagtatacaatatttgtctttctgtgactggcttaattagcataatgtcttcaagttttatctgtgttgtagcatgtgtcagaacttccttcttttttaaggctgaataatattccattttatgtatacataacattttgcttatccatttatctgcaacttgagttgcttccaccttagagctattgtgaataatgctggcatgaacatgggtgtacaaatacctcttcaagaccctactttctttttttttttttttttggagatggagtctcgctctgttgcccaggctggagtgcaatggcgcgatctcggctcaccataacctctgcctcccgggttcaagcgattctcctgcctcagcctcccaagtagccgggactacaggcacgtgccaccatgcccggctaatttttgtatttttagtaaagattgggtttcactctgttggccaggctggtctcgaacacctgacctcatgatccacttgcctcggcctcccaaaatgctgcgattacaggtgtgagccaccttgcctggccaagaccctactttcaattcttttgagaatatacccaaaagtgaaattgatgaatcatatgcaaattacatttttaatttttaatttttttttgagatggagtcttgctctatcaccaaggctggagtacagtggcatgatcttggctcactgcaacctccacctcccaggttcaagaaattcttgtgcctcagcctcccgagtagctgggattataggcatgtgccatcatgcccagctaatttttgtatttttggtagagatggggttttgccatgttggccaggctggacttgaactcctggcctcaagtgatcggcccacctcagcctcccaaagtgttggcattacaggcatgagccaccgtgcccagccccatttttaatttttgaggaaccaccgtaactgttttctgcagcagcttcaccatttcacattcccaccaacagtgcacaaggattccaatttctccacatcctcgacaatgcttgctattttctggagtttatttatttatatagttttaaaaatgagatggagtttagccatgttgttcaggctggtctcaaactcctgagctcaagggatctgcctgctgcagcctcccaaaatgctaggattactggcttgagccactatgtccaatcctggagtttgttttgtttagagtagccatcctaatagtgtgaagtggtatctcactgtagttttgatttgcaatcccctaatgattagtgatgttcccctccttttcttttcattttgccttctttttttttttttttttgagacggagtcttgctgtgtcgctcaggctggactgcagtggcgctatcttggctcactgaaacctctgtctcccgggttcaagtgattctcctgcctcagcctcccgagtagctgggattacaggcacctgccaccatgcccagctaatttttatatttttagtatagacggggtttcaccatgttggccaggctggtctcaaactcctgacctcaggtgatccacctgcctcggcctcctaaagtgctgggttacaggcgtgagctaccacacccggctgccttcattcttaaaggatgttttgctggctatagaattctggattgatttacttttttctgatcctatacttgaagatattgtttcactgtcttctgatatctattatttataagaagaaacagcattcatttgtatcatcattccctgcatatagtgagttgttttctctggctttcaagattttctctttatctttggttttcagcattttgactatactgtgtgcaggtatggttttcttcatatttttttttttggtggggagagggttacttagcttcttaaatctataaatttatctttcaacctatttagaaaatttcaacctctttttcttcaaaataatttttctgtcccatattctcttccttacttctgagactccagttacacatattttagctcttttgctatttcccctcagtttcctgagagtctattcattcccgccctctcccatccattttctgtctgttacttagattgagtaatttttattgatttctcatcaagttttctgacttttttctcctgtcaccttcaatctgcttctaagcctgtccagtaaagctttaaatttcagatattaaacttttcaattgtataatttacatttggttactatagtttttatttctctgcttgtattttctttcattaattatgagtaatattttcctttatatatgtactctgtttggcacaattttaatagctgctttaaagtctttgttataactcaacatttgatgcatgtcagcatcagactcttgagtactggggtcacatttcatttttatgtctagtaatttcagattgtaccttggatattgtaaaagataccttgtagaagttttggattctgtcacatttctccaaaagggtttgtttgtttgttgttttaagtaggcaatacatatatccctttcttcttttgtttaaatgtcaattttagttttgccagttgggtgcagtggctcatgcctgtaatcccagcactttggtaggtggaggcaggaaaatcacttgggcccaggagtttgagaccagcctgggcaatgtagacagacatcatctctacaaaaaataagaaattcgctggatatggtggcatgcacctgtgatcccagctacttgggaggctgagggaggaggaccccttgagcctaggaggtcaaagttgcagtgagccatgatcatgccattgccctccagcctgggtgagaccctgtctctaaaaaataataataataatttttgtcaaagtgagatatacacataattttaaaaagtctaacacaatgacaaagcttgtaatgacaatagtagaacactataccaccatttccaccctgaaacctgcccctcaggaagaaaaacttttaattctttcagctgtttcttctatttacatctacttttctaaaaatatttctaaaaatattcatatatatagatatacacacataattttcatatgtacatatatatgtatattcatatatacacacacacttttttttttgagacaggatcactctctgttgcacaggctggagggcagtggcgtgatcatggttcactgcggccttgaactcctgggttcaagtgatcttcccacctcaacctcctgagtagctgggactgcaattgtgcaccactatgcctagctaatttttaatttttcttttgtaaagacagggtctcactatgttgaacaggctggtttctaactcctgggctcaggtgatcctcctgcctcggccttccaaagtgttgggattacaggcatgaaccaccatgcttgacctctcatatttttatttatatgttatctattgacgttctattatggagtcacaaaatttagcacacttaaaacctccttccctctcttcatactcccaatatatttgtagtacatttttgtttatatcaatatttatactgtttatattatctcactatataacacttgctcaatgttaagccaagtaatataatactgataagataaatttttattcatattagaattaataattgccctgtgggttgttttagcagttttctatgtaataattactagttcaaccttaaacttagcaatataatggtgatacccctctgaatgttgataattcctattgccttcagctatgcctggtatccctatgtttagatgctgtaagtttcttaacacacagtcagtcttctgctggagtgggaaagaaggtccatctgtctttgaaaaaggagttctggccggggccggtggttcgtgcctgtaatcccagcactttgggaggctgcggcaggtggatcacttgaggtcaggagttcgagaccagcctggccaacatggcaaaaccctgtccctgccaaaaatataaaaaattagccaggtgttgtggtgcacacctgtagtcccagctacacaggaggctgaggcaggagaatcgcttgaacctgggaggcagaggttgcagtgagctgagatcacaccactgtactctagcctgggtaggcaacaaagtaagactctgtctcaaaaaaaaaaaaaaaaaaaaaaaagaaaagaaaagaaaaatggagttctaggggtctgagtgagccatgtaaggtttttcaatggatccttctcttttcatctgtaacatgaatttctgcctttagagatacctggtgcctccaaattctgagcatgtccaagatcctctggcaatatcagttttcttctcattagcatactcttggttttaagctttcataatttgagtaacactagtaatttctatcttccagaaatctgctgacattgcttgtctgcacctgtgttcgttctgtgttttgtccctccacatccattagccatatttttctgccccgctccgtatcctgagaagataacacctatggacttgcactcctttgatttttggcatccagttcgattcagctaactggagtgactggaagaagaatgcagagtgggaggggatagaataatagatgtaagcgcatttattgccattgctgtgccccctttttatgtgcctcttccctggaggctgctgtgttggtagtggcagaaaacttgtacctaactccatggctcccctagggtgactttctcctatgcctggagttcttaccaggttacagtaattattctttccacttgccccttgaggcctagggatggtgacagcttcccagtgttgctagtgcctgggtactttagcatctctttttggttctcttaatcctgcccacacctctgtaaatagtttcctcattaaattttcttcatttctcctttgagcatgccaatctgtttcctgccagaactctaactgctatgttgctgttcacgttccccctttactatgtttattcatttcaaaaattttattctcattttagcagagtttctggaggcaacagaaataagtgtcatatgctcaatctgatgcgtttaattattgaatatccttttctccactatccctatgcataagtatttgactctactttctttttctttcttttttttctttttttttttttttttttttgagacagaatctggttctgtgctcaggctggagtgcaggggcacgatctcagctcactgcaacctctgcctcctgggatcaagccatcatcccacttcagcctcccaaatagctgagagggaccataggtgcatgccaccactcctggctaatttttatactttttttttttttttttttggtagagacaggttttcaccattgttgcccaggctgctcttgaactcctgagctcaggcaatccgcccgccttggcctcccaaagtgctgggattacaggcgtgttttatctgagttccttcctcaggaaagaaccttcaggcctctcaaaaaaagtgtcaaagaactaaaactcaccagatcaccacatcctaacagtgagatgctggaccgctcattcatcataattgcttccgtgtccctccctagttctggatttcttgcacattgttacatttcttccctcctatataaacccctagttttagtcggtcagggagatggatttgagattgagctgctgtgtcctcggctgcagcaccaggttaaagccttcttccttggcagtactcggcatcttagtgattggctttctgtgtcacgagcagcaggacctagaccgcacccctggtgtttcggcaacataagcagtatctcaccaatgttctgtgactttcttcctttgattgccttgaagtttctgatcttgctcttctttcttcagaggccagttgaaggccacacccctgtctgctgttggctctcactgatttgtctaaaggctgtgggtacttggggtcaaattgttgatgtttgtgctagtgatggtacttctttttttcttttctttctttttttatttttttggagacagtctcactctttgcccagactggagtgcagcagcaccatctcagctcactgcgacctccacctcccaggttcaagcaattctcctgcctcagcctctcaagtagctgagactatagaagcgcatcaccatgcctggctaatttttttgtatttttaatagagacggggtttcgccaagttgaccaggctggtcttgaacacctgtcctcaaggaatattcctgccttgacctcccaaagtgctgggattacaggtgtgtgccactgccccctgccagatggatgctatttcttgtcattgctgaagctgctggctccaatgctgttgacatttcacaccctcactgcaccca

SEQ ID NO: 818 - DNA, 701039 bp, Homo sapiens
  misc_feature (461233)..(462232): n is a, c, g, or t
  misc_feature (510728)..(511727): n is a, c, g, or t
acacagtagtcttcaaattcctacaaatgttattatggattcttggaggtttccataccctatttcagttaggcatttatttaatgatttaagaagatttttgtcagtgttgttaatcagttatgatatcaaactactctttatatatcatttaagcctattttaattatatggttgagatgtgtagtagtgattttaacactgtactttcaggccaggcatagtggctcatgcgtataatcccaggactttgagaggtagaggtgggaagattgcttaagcccaagggttcaagaccagcctgggcaacatggtgagaccccgtctctgcaaaaattaaaagaaaaaagtagctgggcatggtggcgtgtgcctgtggtcccacctacacgggaggctgaggcaggaggattggttgaggccaggaggaggtcagggctgcagtgagctgtgttcctgccactgtactccagcctggatgacagactgagaccctgtctcaaaaaaacccacaaaaccaactgttcttttttctttgctttctcatatgatgtatactttttttgaaattcaaattgtttactttgttttttgatttaagtgatgatttactggaggattcagacagtgaagagcattccagatcagattctgtgacaggtatgtaaaaagtattagataatgtatttaaaaaattctttacacagttgtgcatacagctaactaccacttaattctgaatttcttagttaatgctaactctaaatttttgctagtatacacagaagactgaaatattgtgtgtcagagatctcaaattagtagtatgtacatagtgttccatatttaaaatttaaatggtacctatttgagccaaaggaattacagtggatagttacgttaaagttttgtcacatatgtcaggtaattaaatgtttttatttgtataatgtattctgttaactaaaagtagtgtttaaagctctttattcatgtaggtgaataaagaactacattttaatgtgtgaaattatagacattaaaacatcaagtaaatgctgccttactagcttttaagatactagggcaaaataatatacttcgtattttaatgttattttgtaggaaaagctaatagtatgtttcaaaatagttttactatgtcagaatttaaatcctaactcttctacttaatatagtctgattgcatttcctgatatatagcatggtggtattaaagtctgttatttagagttttaagaattaggccaggcttggtggcttacgtcggtaatcctagcactttgggaggccacagcgggtggatcacctgagatcaggagttcgagaccagcctggccaacatggtgaaaccccgtttctactaaaaataaaaaacaattagccaggcgtggtggcgcatgcctatcccagttactcaggaggctgaggcaggagaatcgtttgaacccgggaggcggagattgcagcgagctgagattgcgccattgcactccagcctgggcaacaagagagaaactctgtctcaaaaaaaaaaaaaaaaaaaaaagatttagataagataagttcatataaagtgtagtgcctgggaagtacccagtatttttaaaaagtgaccattattaaattgtggctattgtttaatgttagatgctgtgtactatggacatatataacttaaatctttttagaagaggaatggttttgtatagtacagttcaaaaaaattatagttaacatttggtagtaaatattctttaaattttatcatcagatttttttgaaaggcactaaatggaacactggacaattttgggttaatctttagcagtcttttgaagcagttcttagcaatgaacaaaaaaaatcaccaaataaggcaggaaaatgcccttaaaaatgtgcaaatgtgtaattcgttctagagaagttaaaaattgtttttttttcttttaaaaaaacatagactgaggaagctaatgctcttttcctattttgttcttttgcaaaaacataagaggttactactacattttctttctttgtttctttctttcttttttttttgagacagagtcttgctctgttgcccaggctggagtgcagtggtgtgatctcagctcactgcaacatccgcctcccgagttcaagggattctcttgcctcagcctcgtgagtagctgggattataggtgcctgccaccacacctgactaatttttgtatctttagtagagatggggtttcaccatgttggccaggctcatcttgaactcctgacctcaggtgatctgcccaccttggcctcctaaagtgctaggattacaggcgtgagccaccgtgcccggccagacctggctctttcttttgtttttttgagacggagtgtccctctgtggccaggctggtctcgagctgctgacctcaggtgatccacttgcctcagcctcccaaagtgctgggattacagaggtgagccactgcgcccggccaagtttttgaactctttcaaaaaataactccttggtcttgttaaattacttaaactgtgggcttcagtttttcctttgtaaagtgtttgctatgttaagttttttttgattgtcactggaacctttcctttgtgtgctatagttttgttattttccctgggtctaaggatctcagtacatgtttttacagttacaatactcgtatttggccaattttcttaccctttttctacctttattcttttcatctatgcctgtttgatttttcacacattttaaagatactgtaatcatgtttactttagctaatagtgtcttgaaaattatcatgtatttttgtcgactacatatagcacttcatttaggggtgtaaaaattgtctttatgtattaaacagtagctgtggtaagagaaaatatctttccagttcaaaatttttaattgcctcatttgaggatttgtaagtagcttattcattcacagtaaaagtatgtatcttctaaactaattttgttatattggaagaccattggtgactttatggaggcttatagagtagtcatgtatatatatttgatattaatgattggtgtcttctcttcctgaagtatctaaaaagtgataaggtaccatttcagacttatcagagcatatccaatttggtggaaatcacagttctaagtgattttcatcaaattggatgatacaatctgaagaattatgaaatatatttattttctgtttttttttgtttttgtttttgttttgagatggagtctcattctgttgcccaggctggagtgcagtggcacggatcttggctcactgcaacctctgcctcctgggttcaagcaattctactgcctcagcctcccgagtagctgggattacaggcgcccaccaccacacctaatttttgtattttttgtagagatagggcttcaccatgttggccaggctggtcttgaactcctgacctcaagtgatccacctccgtcagcctcccaaagtgttgggattacaggtgtgagccactgtgcccggcctattgaaatatatttcttaatttcaaaaatgtgagtgcagataaagagacatttgttttttagttggaggttatgaggtttgaagatatctaagaggactgcatagggaaaagtttggtatttgaaccacagatcagaattaagtatacatggcttcttgtgaagattgagaagaatgtttggtaggaagttaaagaagggctcaaattgaaatttgagttttaaaagagtgcctagataaaacctaattgcttacctgaggaagtttggttaacactacccaaataagcagaatagagaagggtttttaaaatgattgtctgaagaatattatgctggtgcttgtttgtaggtatttgtgtaaaaatttattttttggcctagtaggttttagaaattctgaaataggtagagttgacaagttctgcagggcgtttgtcagtcatcagtgtgctttgtcacccttctgagtagaatgtatagtttatgctgcttcccacatgttgaataaatatttgagaagcagcaaagtaataatgccacttgtaatattttcctttttaataaagtctcacctcacataccatttactttgaatattgactgaaatttgtgttaatatatgtaatttatggtttattttgtcatagtatatacatagaccaaaattgttttttcttggcagtttcctacatagattagaaagaaaacatttaagtaaatttgtcagtttagtccagttgggcatcctcaggatttattgtggtatagtacatgttataaaaatatctcagttgatcgcgccactgcactccagcctgggcaacagagtgagactccgtctaaaacaaaacaaaacaaaaaacaaaaccacctcagtcagccttcaatttccaatctgaattgtagagaaaatatacatgaatattgaatgacagaaaaaaggctgcatgtgactatagccaaatgagtatttaaataagtgaacagcttcattaatacaattaaatcatgtttatactgaaaatttttttctgctgtagctagaaaatatttccgttttagggggtagtagtcatgttatgtgaaatgacatcatccccagattatgggaaattctagatatgccagtgagcatgtagaagagatcatgaataaaatagtgtaaaatggtgtaaacagagctttgagttaccctaagtggttcttcatgaatctcagttgcttattgctctacttgggcaacttcttttttttttttttgaaatggagtctcgctctgtcgcccaggctggagtgcagtggcgcgatctcggctcactgcaagctccgcctcccgggttcacgccattctgctgcctcagcctcctgagtagctgggactgccggtgcccgccagcacgcccggctaaatttttgtatttttagtagagacggggtttcgctgtgttagccaggatggtcttgatctcctgaccttgtgatccaccctcctcggcctcccaaagtgctgggattacaggcgtgagccaccgcgcccagcctatttgggcaactttcaaaccttcatggagtcaccttgagttcattttttttcttttaagacggagttttgcttttttgcacaggctggagtgcaatggcgtgatcttggctcactgcaacctctgcctcccgggttcaaacgattctcctgcttcaccctccccagtagctggtattacaggcacatgccaccacgcttggctaattttgtatttttagtagagacgggagtttcaccatgttgaccagtctggtctcgaactcctgacctcaggtgatccacccgcctcaccctgccaaagtgctgggattacaggtgtgagcctccacgcccagccttgagcacttttatatttatttccttttctctgtttttccaatctaaatcattaaggcaattatatatatatatatatattttatttttttattttttttttttaaattttctattttttgtattttcgaaaatcgcctagagtggttttttcttttgagacgggatctcactctgttgtccaggctggagtgcagtggcgtgatctcagctcagtgcaacctctgcctcctgggttcaagcagtttctcttgccacagcctcctgagcagtgggactacaggcatgtaccaccatgcctggctactttttgtgtttttggtagagacggggtttcaccatgttggagaggctgttctcaaactccagggctcaagtgatctggcctgccttggcctcccaaagtactgggattacaggtgtgggccaccgcgtctggcctaacctgtagtggtctttatggtattattgctaatgatgttgctgcctgactgaaagaagtttctgccattgagatagagacagatcagtggaaagaattttcagtttagcgtcaagagattatacttgatttgggagttgactgacatctattgtaagactttctttcctttttttgttttctggaaacggggttttactgtgttgctgaggctggtcttgaacggaactcctaatctaaaaggatccttccacctcagcctcccaaatagctgggattacaggcatgcaccacaacgcctggctttgtgattaatatcacaggtttaaaggttgagactgagaaactcagtcctgtgtttcagtatagaaactgagttctgagactgtactacttttaagggaatagtttaaagaaggcacaatagaaaaaaggtcagcagggcatggtggctcatgtctataatccgagcactttgggaggccgaggtgggcagatcacgaggtcaggagttcgacactagccggaccaacatggtgaaaacccatctctactaaaaatacaaaaattagccaggcgtggtggcaggtgcctgtaatcccagctactcaggaggctgaggcaggagaatcccttgaacctgggtggcagaggttgcaatgagctgagattatgccattgcactcccgcctgggtggcaatagtgagactttgtctcaaaaaaaacaaaaaaaaagaaaagaataaaggtgaataagatgatataatgtaatgtagttgtgtggctttaaatgaaataaagattagcagataatacagaagacactgaatgtttcacataaagatgatacagttttggaactttttcttcctagttatttttttttttctaaactgaggttagaattgtattttctgacattccactgataatcagcagaggatggggtgagagagaagaaatggtgcttataactccttcagagtggcgaaagaaaggaaactgagattacaatcttttttaatggatattttgcatagcgcataaatgacagatgcataagtagtattctctctttggtttagaattgaagtgcagaaattctgttactttgatattaatttaaagttatgtataaataatattttttaactctttaatcacattacttttttgaaaaaaggttttgctcacaaattgccaagagaatatattttgaattgaaaagacttttttttttttttggagacagtctcactcttgttgcccagactagagagtacagttgcgtgatctcagctcactgcaacttctgtctcccaggttcaggttattctagtgcctcagcctccctgagtagctgggactacaggcatgtgccaccatgcccggctaatttttttttttttttttttttgagacatagtctcactcttgttgcccaggctgtggtgcaatggtgcggtcttggctcaccacaacctccgccttctggcttcaagcgattttccagccccagcctcctgagtagctgggattacaggcatgcaccaccacacccagctaattttgcatttttagtagaaatggggtttctccatgttggtcaggctggtctcaaactcccggcctcaggtgatctgcccgcctcagcctcccaaagtgctgggattacaggcatgagccatcgcgcccagcctctaattttttgtatttttagtagaggcggggttttgccatgttactcaggctggtctcgaactcctgagctcaggtaatctgcctacctcaacctcccaaagtgctaggatgacagatgtgagccacctgcctggcctaagttgaaaataattttgagtcccttgaatacctttacggtttttctgagtaagctcatcttagatttgattatgtcttaagaaaaaaaaaaaaaagaaaaaaaacagcctggtatttatgggggattggttccaggaccctctctagataccaaaacctggatgtgctcaagtcccttgtataaaatggtatagttttgcttataacctatgcacatctacattttcctgttactttaaatgaactctagattacttataatatctactacaatgtaaatactgagtaaaaagttgttatgctctattgttaattggcaaaaaagtttgtacatgttgtacatgtttagtagagatgcagccatccatttttaaaaaaagaaagttttccggctgggcacggtggctcatgcctgtaatcccagcactttgagaggccgaggcgggtggattacctgaggtcgggagtttgagaccagcctgaccaacatggagaaaccatgtctctactgaaaatacaaaattagctgggtatggtggcacagctattcttgcggctgaggcaggagaattgcttgaacctgggaggcggaggttttggtgagctgagatcacaccattgcactccagcctaggcaacaagagcaaaactccatctccagaaaataaataagtaaataaaaaatgttttccatctgcagttagttgaatccgtggatgtagaacctgtgaatatggagggctgactgcactttaaatttttttaggccaggcgtggtggctcacgcctgtaatcccagcactttgggaggctgaggtgggtggatcacctgaggtcaggagtttgagaccatcctggacaacatggtgaaacccaggctctactaaaaatagaaaaattagctgggtgtggtggcgtgagcttgtaatcccagctacttgggaggctgaggcactagaatcacttgaacctgggattcagaggttgtggtgagccgaaattgcaccactgcactctagcctgtgtgacagagcaagaatttgtctcaaaaataaataaataaataaataaataattttacttgtgtattcataatgtgctgactggatgagtagaaacatatctaatgaatattgttcctttttaaagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtaagttgtctgattatgctataaatcttataaaatccatgtatatatggcatttgtttatgtgcaaacctagtatgaattttaggttcaaatagatggggaggaattaatttttttgtaatgaagtggtaaatccttctttttaaactgttcttaaaacttttttctactgccctaggtaaggattctaactgtaaataagttagtaagtcacttagcaagtatcttctgctttaacctcaagaaaatcacgtgcttttatttcagtgagtccctgactctgcatctgctcaaatttatgaccttgggcaagttatgttaaattcattaaacctgtttttatttatttataaactaggataagaaagtccatttcctaggcttattagaatgaaattatgtaaagtttctggcacagttattggtccttatttccttctgaaataaaaatacttagcaaacaatttttagttttgctaaatacatttttttgtctgatttattcctgatctttggctagtagtgaattagttttgcaaattttgaagcactatatagattaagatagtgtgcagttattttttctttttttctcctttcttttccttttcctttcccctttccccctttctttcccccctcccctttctttccccgtcctctcccctcctttcttttccttttatttttgagaggaagtttcattcttgttgcccaagctgaagtgcagtggcccaatctcagctcactgcaacatccgctcccaggttcaagcaattctcctgcctcagcctcccaagtagctgggattacaggcacgtggcaccatgcccggctaattttttgtatgtttagtagagacagggtttcaccatgttacccaggctggtcttgaactcctgacctcaggtgatccacccacctcagcctcccaaagttctgggattacaggcatgagccaccatgccaggccttttcttttctttctcagggtctcactgtgttgcccaggctggagtgcagtggcatgatctcagctcactgcagcctcaacctcctgggtgcaagtagtcctctcgccttggtctcctgaatagctgggactacagtgcatagctgggactacgcactaccatgttcagctaattgttgtatttttttgtagaaatgggatttcgccatgttgctcaggctggtctcaaactcctgagttcaagtgatctgcctgccccggcctcccaaagtgctgggattacaggcgtgtggcattgtgcctggcctattttttttacttatatacattttaagttagggagataaagcagtttttgaaaaggattactgacaatatcaggcaaaatgaatagttctattgattgtctagcaggaatttaggactaggagatagttgaagcctaagtgactgtaactaaggcatggcagaggaattaggatctgagcagagttacgcatgcatctcatctgtggttctgatagtaattagactgtttttcctctctttaaatagatttcaagagtttagccaaggaacgtaatggtgaaatgtagtggttagattgccttttttgaactatatgtagtgaaattatttttttatttttattttttgtttttgagacagagtctcaccctgtcaacaggctggggtgcagttacgcaatcttggctcactgcaacttctgcctcccaggttcaagtgattctccggccttagcctcctgagtagctgggaccacaggtgcgcgtcaccacacttggctaatttttgtatttttagtagtgacgaggtttcactatgttggctagtctggtctcgaactgctgacctcgagcgatccgtctgccttggcctcccaaagtgttgggattataggcatgatccactgtacccagtgaaatttctgtaatttctagtgaaagtataatggaaaaaaatctttaaatatcataaaaatccaactagattaatttagaaaatgagcagtgtagtctagtaactttagactaatgaaacttggaattacagttgagaatttcagaacaaccattaaaattctgtgtggtatcagagataatttgaatttattggtcatatatgtgccagttcattgttgtaagaactttacctgtgttcgtttagtcatcacaccaactttaatatactattattgtctccgttttgtacataatgatactgaaggaaagaaaggttaagtaacttattaagtaatagagctaataaatgtcagagccagcattcaaacctgggagtcttccatcagagcactttaaatggcattatactgccataatacaacaaaagatgaagaatcttacactgaattctttgcattcttttaatctgaaagatttaaaaattgacaattatttaacttgctgtaggtcatctaaaatggagctggacttggaacctaggtgacatggcaccccggtgcacatctttataagaaactactattttccagaaatgcaataagggtttttaatgctttcaattatttgatgagctatgctttaggtaactcagaagagaaatagtatttacaccttaaatatttaagttattaagttttttagcatttaaataaaagtattggccaggtgtggtggtgcatacctgtaatcccagctacttgggaggctgagacaggagaatcacttgaacccaggaggagaaggttgcagtgagctgagatcgcgtcacttcactccagcctaggctaccgagcaagattccatctcaaacaaaacaaacaaacaaaaaagtatttaaaatagatggtggttttcttggagttggtacagtccggaattcctagaacatgatctcatgtgatagggaatttatccagatgatgaaagataagaaaaacctgagaagttagttgctttcaaaatgagctcctaattcttcagggattgactgatgaaggtgcatttgaaaagataataacaaagcggaaagaaaagttgatgccttaaaatgtatgtacatgtatgatttttaaaaagcatctcagactgaatcaaatggatgtgaccctgtcttctgagtatattcaaataacataaaactatttttcttgtggagaatcaagtcttttcataaaaataaatctatagttaatatatgttttaagttaattttatataggattaataatatactaaatgtagatttgttaagctatctttgataattcaggaatagaatatatacacactacatataaaattttgtaaaaggcataaaataaaaaagtatgaatttcaaaaattgagagtttaaagtgaaagataaattggtattctgcttggtgcaaatacatttaaaatcaacaggaaagacttaaatgagaaagaagactaagatgtatcagtggagtataagatagggtgcagttatgatacttgacaaaaaatgcttaaaaaataaagttttttaaaaggccgcaattaatagggaacatatcatgaaatataacaatactgaatataaatatgaccccaacaacataaagcctatatacctgtactgatattcagaaggaggataataagttgagccataattgctttgaaagtctttaataatctcactatctgggattattggactgtatggtcacatccttgttttggtacttgtttcttgtggaaaacattcctttagtcttctgttcctgctttgctaagagtttccaataggaatgaacgtcatattttgtcaaatacttgtttacatccatggagatcatttggttgttctttttagttcagtatggtaaaatatattgattgacttttggatatcaaatcaactttgcgttcctgggataaaacccatttggtcataatgcattaccttatatattgttggatacagtttgctaaaattttgttcatagtttttgcatatcgttcatcagggatattatatgttccttgtaatctttcttttttagtttttgctttttgtaatctttatctggttttgatatcagtgtaatgcttgcctgatagaatgagttgggaagtattcgctcttcaattttgtggtaaagtttgtgtataattggtcttatttttccttatatatttggtagaattcgccagtgaagctctttgggcccagagattttttttagtgggaagattttgaatatacacattcaattatgtttatagagacttcctaaggttttttattttttattttttagtgagttctgacagtctttttgtcagtttttaagttatgaagttttagcgtaaagaatttcataatattccccacaatcattttatttactttttattttttttgagacagagtcttgctttgtcacccaggctggagtgcagtggtgcagttttggctcactgcaacctctgcctcctgggttcaagtgattctgtcacctcagcctcccgagtagctgggactacaggtacaccaccatgcctggttaatttttgtatttttagtagagatgaggttttactctgttggctaggctggtcttgaactcctgacctcaagtgattcacctgcattggcctcctaaagtgctgggattacaggtgtgagctaccatgcctggctccttacattccttttaatatttgtagactctttagggatgtcaccactctcatttgtgatactgatcgatgatttgtattttttttttcctgcttcatctgtctagaggtttatctgttttattgattttttttttttttttcagaacaaccagcttctgatttaaatgacatttttttctttgttatttttctgttttcccatttactggatttccattttattgttattatttcctcccctctgcttgatttgggtttattttgctcttctctagtttctttctttctttctttctttctttttttttttttttgacacagagtttcactgtcgccaggctggactgcagtggctcgatcttggctaactgcaacctctgcctcccaggttcaagtgattctcctgcctcagcctcccgagtagctgggactacaggcccgagccaccacgcccagctaatttttgtatttttagaagagacagggtctcaccacgttggccaggatgatactgatctcttgacctcgtgatctgcccgccttgacctcccaaagtgctgggattacaggcatgagccaccgcgctggccttctttagtttcttaaagtagaagcttattggtttgagatgttttctaatataggaaatttaaagccataaatatttttggaagcactgtcttagtgatacctcctaaattttgatacattgtgtttttcctttttttcatttggatcaaaatatgttctaatttcccttgtgatttcttgtttggcccagagattatttaaaagtgttttgtttagcctccaaatacttgaggtttctctagatttctttctgttctggatctcaaacttatttccattgctgtcagagaatataatttatatgaagtcagtattttgaaatttattgagactttttcatgacccagcatctggtctgtcctggagaatgttctgtgtgcacttgaaaagaatttgtgttgggcacccatggggtagagtgtcgtataaatttcacttgtatacgtgtatgttttttagttgttgaagtcttcctgattttatattgagccttcttctatcaattttgagagcaagtattgaaatccctaactatgtttttgttgaattgttcacttttaagtctgtttttgcttcacttgacttttggctcttttgttagactgtttcataattgttacatcgttctgatgtattggttcttttgtcattatgaaatattcctctgtctctattttgtgtcatactaataaaatcactctggttttcttatggttacagtttgtattatgtatcttttccacaattttactttcaactaacttgtgattttgaatctgaagtgggtctcttagatgcatataattaggtcttgcttttttatacagttggataacctgtaccttttaaatttgaatgactttacgcttaaggtaattattgctatggttgcatttatgtctgccattttgagtttttaaaatgttctttacattcctttgttactccttcactgcattcttttgtgttgaataaatatttttagtgtgccattttaatccctctgttgattttttttttagaagaaaatttacataacattagtgaagaataatttgttagggacacccagagacctactgtcaaaccaagaactaaagcagtatggatatcttgcatctatgaatgtgtccctcctcccctctcccaaactctgcccttttcctacagataattgttactcaataatttttatgtctttccttttataaagaaaactggttttatgctttggatgtgaatatttcaacatattttattgattttgcttgtttttgccctttataagaatgataccaaactctaactagttttgggggacttgattttcctctcttactatgttttaagattacccattttgttgcatgccttgtagatcatttaattttcacttatacttagtactccaatgtgcaaaaaacccacaaataatttatgcattttcctgtcagtggacatcttgtttatttctgtttttttctgctataaacgtcttgtgtaagttccttggtgcacatatgtaaggggctctctatttttttatttttgaggcagagtcttgctctgttgccaaggctggagtgcagtggtgccgatctcagctcactgcagcctccacctcctgggttcaagtgattctcctgcctcagcctcccaaggttagctgggattacaggcgtctggctaatttttgtatttttacaaaacagttggggtttccccatattggccaggctggtctctaactcctgaccttaagtgctccgcccgccttggcctcccaaagtgatgggattacaggcgtgacccactgttcccggcctgagactctcagttcttaagagtagaattattgggtcatgggttataattttttttttctttttaaaatgtgttaaatatatataatgaggtttactattttaactgttttacagcatgtaatgtagtggctgtaatacattcacaatgttgtataaccaccagtactgatttccagaactttcccatcatcctaaacaaaaactctgtaaccattaagcagtaacttcccattcattctaccctccgctgctggtaacctcaattctacttctgtatgactttgcttattgtagatacctcatataagtggaatcatgtatttgtccttttgtgtctggtttctttcactcagcatattttttatgtttttaatgctcacccatgtatcacatcttggttcctttttatgccaaataatattccattacagtagggcccatccacccccccaatccctgccccttatctgtggtttcagttatctgtggtcagctttggtctggaaatattaaatggaaaatttcagaaatcaacaattgataattattaaattactcaccattctgagtagtgtgataaaaatctcttcttgtcccatccaggacacaaatcatcattttgtccagcatctccatgctgtatacactacctgtctgttagtcacttagtagctgtcttggttatcagattgtctgtcactggtatcgcagtgcttgtgttcaagtaaccattttacttaataatggccctaaagttcaagaatggtaatgctagctatgggatatgccaaagtgaagccgttttgaagttttttctttatgttgaaaaggcgaaatttttgacttggaaagaaaaatattttatgtgcagatttctaagatttatggtaagaacaaatcttctgtttgtgaaattgtgaacagtatattgctatcattgtgctattttgttgttgttcatctcttcctgtgcctaatttataaattaaatttatcatatgtgtgtgtgtatatatatgaatatatatatatgaaaaaacaatatatatacatattgggtttgatactatccacagtttcagtcatcactgcgaggtcttggaactgtgactactgtaaggggtgactattgtaactcagcatttgggttgtttccacattttggctattgtgaataatgtccctataaacattggtgtacaaatatttgagtacccgttttcagttgttttgggtatatacctaggagtggaattgttgggtcacatggtaattctatgttcaaccctttttttttttttgagatggagtttcacgcttgttgcccaggctggagtgcactgacgcgatctcggctcactgcaacctttgcctccccggctctagtgagtctcctgcctcagcctcccaagtagctgggattaggcacgcaccaccacgcccagctattttttgtatttttagtagagacactatttcgccatgttgaccatgctggtctccaactcctgacctcaggtgatcctcccacctcgcccacccaacgtgctgggattacaggtgtgagccaccgcgtctggcctatgtttaaccttttgagaatcaccaagttattttccacagagtctgcaccattttgcatttccacaagcagtttggaagggtcccagtttttctacatcctggccaacatttgttatttttggtctttttgacaactagtggttgtgaagtggtatctgttgtggttttggtttgcactttcctaatgattagtgatgttgagcatttcttcatgtgtttattggtgatttgtatttctataatagacgtagaaatatctattcatgtccttgtccacttttgaatttttttttttttgattgagttgtaggaacatttttagaaattcaggattcatatcttaatagatatgatttgcaaatacttactttctcatattctgtgggttgtctttttactttcttggtagtgtcctttgatgcacaaaacattggcattttgaaaaagtccagtttatctttttgttgataatcttacattcatacatcattttcctgtttttctttagtttttgtccattgttccctttagctaattggctatataaagagaattcatttaacgtttttgactaataattccaatatctgggctttctcaggtatgctttctggtaattctttttttttttttttctcctgtaaatgggccatactttgctgtttctttgagtgctttgtaattttttgttgtagtcagaactttctgagtattgtaatgtggtacctctagaaatcttattctctcactctgggagattttgcttgtttccagctgcagccatccatttgtgacattttcaaactatttgtacaaaggctagagaaccctctccccactcttatccttccaaaaaagagttctatctctttaaatcttcctgtagatcctgtttcggctttgtccccttaaatcttctggtggctgctgcttggagtagcagctgcagtctcagaagggtgaaacccaggcaagagtctattctggtcccttagggaactgctagaccaaccaaaatgcacaaccctatatattgggaagagaaggtccctcctgtccgccctggcaccagccagctgcttccagcacatgtgccactttcccccacagctgtgtcagggctgagtatggaggggtagctggttcatttaggccaccctcttaccagaaatcagtctcctctgtttattgtagatatcctgttaggtcccatagttctgaaatagttgattccaatcatactttctagttgagtggttgctttggtggagggactgatccctagagcttcctactctgccatttggcatgaaatcactggtccccgtgttgattctggtttctttttctgatactacttttttttgagttatattttggtggtttaattaataatacaatctacttcagaataatactttattctagtaaaatatgtaggaactttgctcttgtctctccccaccccatacattacatttaagtatgttataaacccaacagaatggccgggtgtggtggcttacgcctgtaatcccagcactttgggaggtcaaggcgggcagatcacctaaggtcaggagttcaagaccagcctggccaacatggcaaaaccctgtctctactaaaaatacaaaaattagccgggtgtggtggtgggcacctgtaatcccaactactcaggaggctgaggcagggagaatcacttgaacccaggaggcggaggttgcagtgagctgagatcacaccattgtactccagcctgggcaacagagcgagactccgtctcaaaacaaaaaacaaacaaaacccaacaaaacatgttacaattattttatacaaccattatctttttaaaaagttggcaaagaaatgagaaaaacatttatttattatattcacctacttaccatttctgttctttattttttcagtgaatttgatgttgctttccttcctcttaaaggggctttctttggggctttctttgttacttatcataaggcaggttgctagcataaagttctctcagtctttgtttttctggaaatgtgttcatctcacattcatttttgaggattaatgctacatagagaatctgttgacagtttctttctgtactttaaatgtcattccattgcctctggtctccattgtttctcatagtgatctgttaatttgtgctgttgttttcatgtctgatgaataatttttatcttgctgtcttcatgatgttccctttgcctttgactctcaagagcttatatatatatgtgttatttctttgtgtttatcctatttgagggtcattgaacttgagtgaatttgtggttttctatcagatttggtaagtttttgcccattattttttcaggtggaattctcttcttcatggaattcccattacatgtatgttcttaatattttatctgtcctgtaggtctccaagcttcttttaatttttattttattttattttttttttgagacaaagtcttgctcttgtcgcccaggctggagtgcagtggcgctatctcagctcactgcaacctctgcctcccgggttcaagcgattctccttcctcagcctcctgagtagctcaggggattacaggcgcctgccaccacgcctgtctaatttttgtatttttagtagagatggggtttcaccatgttggccaggctggtatcgaactcctgacctcaggtgatccgcccgcctccgtctcccaaggtgctgggataacaggcgtgagccactgctcctggcctttaatttttttaaaaatatttttgtttgttgagtcgtttataccattatttcctgtaatctctatacccctggtttcctcttattctataaaaatatttacaatagatccttgaattctttgctaaatctgaagtccgagaagacattttcaggtgtgtgtgtgtgtgtgtgttttacatcttgaatgtgggtccctctttctttgcatgtcttgtaatgttttatttatttactggacatttaaaacaacactatagcaatctggattcgtatctccctaccttttgccaggtggttgttgctttgtttgttttgtgaaaacaaacaaactgttgaatctgtgaaatctgaatctgtaaaatctcttctgtattgtgcagctgctgatttctgtcatttattctgcctagttttaatttttaagacttgtttcttattttgtttcttttggggcagcagagcttagtattcagccaaagattgataggtttggtgtccaaatacctttagccagtaaggctgtgctcaagtgtgccctggcttttattttctgttgtgctttctcaggtctcttttgcataggcatagaggcttagttgactgaggatgtaataatggcttcggctccctctggtctttgctggacacgtgcacagcctctgatcaaggtgggatttgtggagagtttaccaggccccctgtgcttctctcactacatgtaattctgtgttaaatccctggtgtttccagtgctttgcttgccccacacagaattgtgacctcaagtagcagatctccttgtttgtttcccattgaaatcacctgtttaaactggacgctctccatcaatcaagtcccatctggagatagcagtgaatgtgctggttttcactgcttacctcaccctcgttaaattacagttttgtctagctttatagttgcctttcaggaaggggatttatcatcttccttcttctgctatgctggaagtgaatctccaaattagaatgttagaatatactattacccattaatttttttgtcttaattaaagctaaatttgctgtcagtttttttcctgtgacagagattttaaactagaaatttgagttgccttcatttcattgtgaatgctttaaaaaataagagtatttgttaagttttgttattgttgagattaagagatctggctgtggattccagtatagctagtgcctcatctgtaaaatggccacagtaatagttctaccacaagggtttttggtaaaaagtaaatgaattaattaaagcacttaaaatactgtctcataaaagtaaatactagataaatacctgttttcatgtatgtttatgtatttatcattttcttcataaaaatttggtttcaatttgtaattccttggcaattaaatttctaaactcttggaaatacatcacattggtagctttccttatctgcctatgaagtgacattcagttgtttcctaagtagtattacatttgaatatttgaatgtttacctatttttcatgtatctatgaaatttactacactgtaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggtatgatattaaatttttaaatgattttaaaaaaagaataggtagtatttatcatttttctagttgttggaagatgtaaacatattaaagtaagaagtgattctcaacctgtatggtatgttactcaatatttgtgaagtcatctaagaggttaaaacaaacatttcagccattaatgagcttttagtctaattagaggagggaaaaatcatataaaagagaattcattaagtaagaataaaattagtagactggctcatattattaatattactactggaattgaaaaggtgaaaaaaaaatactgtcactgaggatatatttaggtggtatattcacacatacgttgccccatcctgaatctctcgataggtttgtttatatttgtttgttgtttttgccttttttctcccatccttgacccacattgccctccagagctaatttttcaaaagaagttttgctagcatgctactccctgccaaaaaatcattatttgccttgtagacttttatgaaatcatagtagcctgcttctcaatctccagttacttgagttaaccaaggtgtcttggttaagtatacaacttggtataaaaagctaaaatactgaatattctcatattttataggttattggttgaatggagaagattttttataaagtacagaaaaatgctttttagtagaggaaagatgaattttgtaatgaagaaataaataatggaaagaaagaagattgacatgctgttaatatttacaaactaagcagatttaaaagggtctagactttgagaaaaagatgtaatttgaattaaacttgtaataattttatagaacttgctgtcatttttttattgtgaaaatactctaaacctaccagattttatattttagtattttattaattttttaaaatgggaacaatggcttagcattttttaatgttatacatttcactgatgtgaatacatgtatagcatttgtaaagaagcctaattagtatgaagcacgttattactcttataatactagcatgtatgcaagattttcttaactgccacagaaatagaaaaaacaatttaatttttcagtttgtaagtatttctttaccacatagcttttgactgttttagtgttttattcatatgttatgtacttgcttgatgtctagcattttattttttaaaaaatagggtctaaaagttaattattggtctgatgtacattggcttgcactttagtaccactgcttttcttgccatccttattagggctaaagttcagtaagcccttttctaacaggttgggtttgggtttcttcaatagcgagtattgtctctaattttaaatatttaagttagaattttcttctttgctattttttagccagagttagttatcttagttatatatagatacctgagcccactttattaactttcagaatatttggcaagtgttgcaatagaaaacctacccatgaattaaaacttcacttcattgtcttctttttttttttttttttttttccacacctatttcaaatactgctctcactaatgttaaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacaggtaaaagatattcccaagataattaattttaagtccatcttgtgtatttgtcagagacaacgtagaattcctaggtatattactgtttatcttttttttttttttttttttttttttttttttgagacagagtctcactctgtcacccaggctggagtgcagtggcgcaatctcggctcactgcaaccactgcctcctgggttcaagtgattctcctgcctcagcctctcaagtagctgggactacaggtgcgcatcaccacgtccggctaatttttgtattttaggtagagatggggtttcactctgttggccatgctggtcccgaactcctgatctcaggtgatccacctacctcggcctcccgaagtgctgggattatgggcatgagccaccatgcctggcctgtttgtgttttaaactgtctaaaagatatacagtaatatacttaggaattctgtgttgtctctaacaaatatataagctaatttttgcatgttgatgactttgttccttctatttgtcatattgcttttggaaattgttatattcttattcttaattttaggataaaataatgagagtaatttactactgcaattagtttggtcacttagtccacagatttatttaacaaatactcaaatgcttgttttgtatttaataaaagcaggcactcttatagtcactagtaatgtgggtctcatggaatttgcctcctaatggcaatagaaagtaaacagatacatataccatgccatatgggcataaaagctatgaagaatgttaaaacagagtatggcaatagagtagtagttggataggaaattgcatgtaagagtgagagagtgagagaaaaagagagacaatgtgtatggtattttcaatataagggacctaagaaaggcttccatgataatagcaatacagaaccctgaggactatattttgtgagttctaggaaaagaaatatgaccattgttgttggagtgctgtgaatataagggagagtggtagggagggagatccaaagaggtagctgggtgccaggcatggtcgctcaaacctgtaatcccagcactttgggaagccaaggcaggtaaatcagttgaggccaggagtttaagaccagcctggccaatatggtgaaacgctgtctctactaaaaatacaaaaagtagctgggtgtggtggtgcacacctgtaatcccagctactcaggaggctgaggcagagaattgcttgatcctgggaggcggaggctgcagtaagccaagattacgccccactgcactccagcctgggctacagagtgagactccatctcaagaagaaaaacagaggtagaggtacctgggagctggatcatgaatgcctttataaaaggtcaggcatggtggctcacatctgtaatcctagcattttgggagactgacgcaggaggatcacttgagcccaggtgttcaagacccacctgggcaatatagggagacctcgtctctataaataataaaaaaaaatttagctggacatggtggtatgtgcctgtggtcccagatacttgggaaactgaggtgggagaatcacttgagcccaggcggttgaggctgtagtgagccgtgattgtgccactgtactctggcctgggtgacagagtgagaccccatttcggaaaaaaaaaaaaaaaactttcatgctacgtgagatgggaaagtgttagcaggtttgaatacaggagtgatgtggtataatttatattttacaaagattactttgacttctgtatttagaatgatggttgtggtggggagggcagtgatagattggttttagtttggttgctgttgtgctgattcaggaatgctgatggtagcttggaccattgtgatagtgatggaggtagtgaaaagagtcgttagattctggatataatttggaggtacaaggaatagaatttgctgatgtattgaacatattgtgtgacaggggagaataaaggatagctttcaggttttggcctgagttcactgaaaaatgaagtttctgtttactgagatttggaagtgggttttttcataatgagtttgagatgtctagtagacatttggatatgagccttaaatttagtggaggagtttggagattttcattttccagcatatatatagcatttaaaacccaagaatgaatatatataagaaatacaataaattgttgttttgaaatgaagattctgggaccctactcatagatctagggtgggtaccaggaatttgcacgtaattcacattaaattgttcacactttgaggaataagaatgtattggtatatgcaagtctcaaggcaggtgtagatttctaaagtaagattattcattgccctttgtttaaccttctccattgggagctattttctctcttgatcccattgagaaacactagattttgttggaagctgcaaagcaaaaagtaggaaaggtgaccttaatgataatatggttgtggctgaagaaagatttttgctttatttagcatttttccccttatttgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatggtaagaatgtatcaaaatttatctttgaagattttattttgtggttgatttctgaaaactaattttcaccttggctaagtttcgtgtccctttctgtcccttgttgccatttgcctgctttactttttgtgattttatttaaaaaagtaattcagagaacatttcagaacttttcagtaacccagtaatgttcagaattgcataaacttgaatcatataattatacttttttggaagtgagattagttcctttgtaaattagtttgacttttagcattactagctttatgtatttcttttcctaggagaagacttaattgtgaatagaactgttatggaagttacttttaaggttattagtgaagccagcctttcatgtaatgctaaaaatacactcatttttatctttcttacaagttcagaatttgttgcattgagttattaaagtagattatacacatttagcatggttagaaactagatgttactactgagtgttttctccttaataagttagtttaagaggctggggataatttcacggtaaaatggcaacttaaccccagtttcaaacattgaaacttgaaaattttcctttttgaaaaattacatatacgcctggcactctctatctgtgggtttcacatcccaggagtcaaccaacctcagaaacaaccaatcgtggattgaaaatactttgggggggaaaaaataaaaaaaattacgacagtaagaaaatatacaaataaaaaatagtattagaccacatgtggtggctcatgcctataatcccagcattttgagaggccaaggcaggaggatcactttagcccaggaatttgagaccagcctgggaagtatagcaagcacatgtctacaaaatttttttaaaaaaattagctgggtgtagtggtgcacacctgtggtgctactcaggtggcagtactcatgaggctgaggcaggaggatcacttgagcccaggatttggaggttacagtgagctatgactgcaccactgcactccagcctaggtgacagagtgagactctgtctgaaataaataaatagtatttgcatggcattcacattgtattaggttttattagtaaactaaagatgattaaaagtatacgggaggatatgaataaggttatatacaaatattatgccattttatataagggactggaacatctgtggattttgacatctgtgggggtcctggaactaatcccccacagatactgagggatggatgactatatgtgtgtctgtatatttatgtgagtctgtgtgtatatggatatgttcatatgtgtgcagtcttttgacagattttgaattaattgggtggaggactcaggatttggtagtttcaaagctctgcaagtgcttgtaccaggcagcctagggtaagaacttttagtttagttgccagcagattgtttctttaggcaaatattttattaccgttaaaagagagaagaatgtataaaacaattgaatcaaaattttcctccaatcattttatagcatctgtgatgaaaatcacagaagttcccaagttaacaggaaattttagatttttcaggcacataaatcattgatattaaagaaaattaagtttactaatatttttatcctctagaaacagcagtagataggcagatcacctttcctttgtctccagctcttaacattgaagtggaacaaaatgggaaaccgtccctggttgatttgaatgaagaaatgcagcacatggatgtagaggaatcacagtgtgagttaaattatagagctgttgtccatgacagtaaaaggagtagtgatctgaatgcaacatgtcgggcaagatttccttatggcttgcaaaaacttggtttcaagaacacaattaaaaaataacctataattctgctttggcaatatgctttaactttcagctcatcttttgtgaccacagctgcgctaatgcattcttggtttttaataccttgggatttgaaatcaagtcgtggtttataatttttttgaaaataaaggtgaactgtaaaataatatgggaatggaaagcaacataacaaataattgattatagttccttagcatgacaattcttattttaacacattctaagtatgatattttgtgtggtggtattatatgtaaatgggatgatatttgcttattaaatattacattttaaatgaatgaatttaaaagaaaaatatgtatttttctttttaggtcttagattatgtccatttttggaggatcataaagaagacattctatgtgggccagtatggcttgctagtggccttgatctatcagggcatgctggaatgttgacgttaacaagccccaaacttgttaaaggtgaagtaatacattttacaaaagcagaattaataataccacagttgtaaaaaagacgaaaaaaaactgatctcaaaaaaaataagattgttttctttgggactttcgttcgaaatttcatcagttttctggtagctgaggtcatttcctgtcataaagtaactaactgtatggttatctgatcctactttttgtgtcttaagaggtctcagtgctttttgaaaaaacgttgaagaaatgactacaggatgacttagtgtgacataacagagctcttttgagtaagcagacataatgttctgccatttttacccttcccatcacatcagagtcccgtctcttcagagttttattatatattattacagtatcttcccttaaaagaggtattttgtttgtttgtttttgtttttttgagacagtctcattctgtcacccaggctggagtgtagtggcgctatctttgctcactgaaacctccgcctcctaggttcaagtgattctcttgcctcagcctcccaagtagcagggattacgcccagataatttttgtagttttagtagagatggggtttcaccatgttggccaagctggtctggaactcctgacctcaaatcatctgcccaccttggcctcccaaagtgttgggattacaggcgtcagcaccgcacctggccaagagaggttttttttgttttttcttttttttttttttttttttgagacagagttttgctctgttacccaggttggagtgcagttctgttatctcagcttgctgcaacacccgcctcccaggctcaagcagttctcgtgccttagccttctgagtagctgggactacaggcgtgtgccacaatgcctggctaattttttattgtattagtggaggcggggtttcatcatgtcgcccagggtgatgtggaactcttgagcccagccactctgcctgcctcggtcccccaaagtgttaggattgcagacgtaagccaccgctccaggccaaaagaggatttttattagaagagcttcgccagtatcatatacaatgatttgagtgtcataaacaaatgcagattataatgaatgttttgagataatgggctatcatgttgataatttagaaatatcagtggtaggacgttttcagcttttgtattctgggggtaaataaaaaaaaccaacacaaaatgactagttcaattgttaaagaaatttggggtggggtgggatgtagagatccttctccaacccaagaaaataactgaccaactatatatcagctatttacatttgtgtacatttgcttcctaatgtttgtccacattcacacataaccatttaattgcagacatagtacaggtcaagtatcccttatctgaaatgcttgggaccagaagtgtttcagatttcagattcttttctggttttggaatatttgtgatatacttaactagttcagtattcctaatccaaaaatccaaaatatgaaatgttccaatgagcatttccttttagcatcatatcggctctcaaagagttttgcattttagagcattttggattttcagattagggatactcagcctgtatatatgcaagttttgtgctttcttattgtcattaggttttcgagatgttatgtgttaggtttcatgctgggatacagtagtgaacaaaaactaatctcaaattgtttagattataggttttgttcaatgagagtgtgcatcttaaatttttaggtggaaatagaaatattggtgtttttaaaaattttttattttttagagacacagtctccctgtgttgcccaggctggtctccaactcctgggctcaagggatcctcctaccttggcctcccaaagtgctaggattacaggtgtgagccaccacgtctggtcaaaaatactgattttgacaaaatggagtgtagaattacatggcatgtgtttggaaagtattaattttcttagaatatactaagatatttttttccataaaattctccccagcatctttgaaactgaataagataagtgctaagtttttttggacgagtaaaggggtaacattggccaaagaaattttgaaacagaatgtcagataccacaacacagagaatagtacagtagtgttaagaaaaatgtaacagtgtagtgctagcacagcaggcaggtagctaagtagagtgatagcatttataatcatgaaagatttaatacctggtaatgcaacaatagactgatagtttgctggcagatgtagtaatttaatgataattaagaaatgtattttatatatagattgtatagtatgatcccaatttggttaatatcacatactagtgataataattatttgagtgttctttttttttttttttttttgagacggagtcttgctctgtcgcccaggctggagtgcagtggtgccatcttggctcacggcaagctccgcctcctgggttcacgccattctcctgcctcagcctcctgagtagttgggactacaggcgcccgccaccacgccccactaatttttttttgtatttgtagtagacggggtttcactgtgttagccaggatggtctcgatctcctgaccttgtgatctgcctgcctcaccctcccaaagtgctgggattacaggcgtgagccactgcgcccggcctatttgagtgctttctttgtgccaagcacagttaacagtggtttagttgactctgaggtaggaaatattactcttattttacattagaagaaactgagccacagagaggataatttgtcatgtgcctaataaatggcagagccatttttcaaacccaggtagtgactccaaagcctgcatgcacatttttaaccgtcagtactataatgctatgtgtatatgtgcacatatatatggatgtgtgtacatgtatgcataagaagactggatggatatacgttctgttattatctagatgatagcttaatgacagttttgtgtgtgtgtgtgcgtgtgtatgtgtgtgtgtagttgatgacatttttaccattaaaatgaataatattggggaaaaaacatgccaaatgtttatctcaattagtcaaagataatggttttatgctattcatatcattcctttgttggttgttttttgctgacagcgtgtgaaggtggttcaactttcttctgctcaaacagtataatttgaaagttctggcctactgtactttttgtggagttagttgttgatcttgttctatgaagatgaaaaacagtggaatttattggtgattcagttattttccccattctactccacttctctaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggtatgaaactgtcattttgaacaataacaatacagttttaaacattgtggatcagatttaacacactattagaagtagtatgacctttcagtgatgttttactatacgcttggtttgtttgtattttgtctttggagtgacttaaatatatttgggaagaagaatgtttgagttaactttattatttcattttatttattttagagttttgagacggggtctcactctttcccccaggctggaatgcagtggcgcaaactcggctcactgcaacctctgcctcccagattcaagccatcctcccacctcaacttccctagtagctgggatcacaggcgtgtgccaccatgcccagctaatttttgtctttgtagtagagacggggtttcaccatattggccaggctggtctcaactcctaacctcaggtgatctgcccaccttggcctctcaaagtgctggggttacaggcgtgagccactgcacccagcctgaattaactttaggcaaattacctagcttttgtaatgtatactgaatagggagtaattgttagcagatatttccctttataattattttagaccataatatttatttcttttggtatgagagtttcttcatatgccctctgttggcaactcacaatcttgtttttggtgactatttgggagtatacagaaagagaagttggggcgtaattttaagacaggttctaatcctcatggttgattttctgaaagtagctgtgaaccatgcagctccttacaattgacttatcttggatttcctggaagtcaggaaggaggttttgtttatcatcattatttataaggaatcatactgatactgatcagtaataccaggcattttacatatatataggtcttccagtttttcaaggacttctgtgtactttatctgatgtaatcttcattataactctgaagtaggcatagcaggttctgttacctcccttttttaaatactgaaagtgagtgaaccttagcgattggggagcctgacatatctcacgtagttattttattttattgtgtttattgatttattattattattattattattattattgagtcagagtcttgctctgttgcccaggctggagtgcagtgatgtgatctcagctcactgcagcctccacccactgagttcaagtgaatctcttgacttagcctcccaagtagtgggattaaaggcacttacccatgcttggctaacttttgtattttttggtagagatagggtttcactgtgttggtcaggctgttctcgaactcctgagttctgtgatctgtctgcctcggcctcccaaagctctgggattacaggcctgagccactgcacccagcggaattagacccaggactttggttttatcatctgtaatcattgggttattgcctttaaaatagtggctgtgtctgtctttttttcccctattataattctggagaaaattagtcatttactgaatatgagggtacaagctatcattttaacttgagatttatattttgatggccacaattcagttattttcctttattttataacttcaatggtaaatgatttttagtttagtttattttttaaaattcattattatttgtaatgtttaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaaggtaatttcattgcattatcttgttattcttacagtaatgaaagtgcagagcataacaccacacacatacacacacaaataaaaaatcttttacctgaaaattttttttgtccatttttcttaaataattataattttgatgagaatatgagttgtctttatacttcattggtttatctctagtgtccgcacagtgcttgttgtatagcaggaatggatgatagttattaatttgacacgtactcgtcaggcaagggagcatgtatctatagtcctagctactcaagacgtgggggtaggaggatcacttgaacccaggagtttgagtccagcctggacaacagagggacacccaatctctggagaaaaaaaacaaaacaaaaagaaattatacacattccatgttacattacaacacattattgtaaatgttattaaaaaattttctacaaatgaaatacttgacatatagctattgattgtttttaaatgtacttgagatgttcatgaattaaaattaaacattgcctttccagccaggttgtgatagctttagttgttctgttttgtttggtaatgtgtttatattttctttttttgtagagtgcaacgatgtgccatgttacagttttcagaatttcatgagaagcttgttaatactctttgcagaaaaacagatgatggccagatcacagaacatgcccagagccttgtgttggatactctctgttggttagctggagttcattcaaatggacccggaaggttaataattaaaattttgcttaccactgttgattgccttttagatgttatgattgaaagttcaggatgagtctaaatgtctgctattgttttgcagctcaaaggaaggaaatgagaacctactttcaaaaacacgaaaatttctgtcagacatcgtacgtgtttgcttctttgaggcaggacgaagtatagcccataagtgtgcccgatttctagccttgtgcattaggttggtatgtttttaagttgaaagcatactttctaggtacacctgcaatttagtgggtgataccttgtttatagtgtgatttgatccttgtttaatgtatgtataatttaagagaatttcaaaagttgatgaagattgttgataatcttagcaagaattttgggttcttaggggaaagtgtcatgttaaataagtctatttaacttttaagaaaagaagtctgctgagcttctctgcctgttagtagcagtttggagaatttggcaagggaactcttaaacccttttcactcctactttccttggttgtcttttcttgccctaaagtgttttctctgttatgtaacaatcttaccgacttttttttgtagcattgtgcagaccctttttttctaaaccctgaaacaaattagaacagtctgccctgatccccagggcatgtgtcccaagacccctcccctccccagtggagacctgaaactgtagctagtactgagccatatatatagtattgttttttcctatatatacatacctgcaataaagtttaatttataaactaggcatagtaagagattaacaataactactaataaaatagaacagttataataatatactatgataaaagttacatgaatgtggtctctcaacatgtcttattgtactgtactcacctgtgtttagactgcacttgaccatgtgtaactgaaactttagaaattgaaactgcatatacgggttcttaatgtttaaaggttcctacttgctactgtatctaggaagtgtctaagagctaatggtcagtattgactgttgtaaagataagggtttaatgcataagaaaatatttacaaccctccttagtataatcagttcccgctatcttttggtattttatatagctttaaggcaggtttttcttttaatcggtatagaatacattttaaagatttttaggtaccacaccaggtttagggttgaatttagaccttgagtaatgtctttacaatttttctttttaaaaatttttcagtaatggcaaatgtgacccatgtcaaccagcatttggacctgttctgttgaaggctttacttgataatatgtcatttttacctgcagcaacaactggtggtatgtaaaattaatttaatcacaaatagttatagtcatatggaacatctcatatgtatacttaggattatttcataactactttttctctattaaagttcacttttctgtggcttatctgtattttttgaagggatcgatagattgtagctgggtggtcatatactccgtcaatagtactccaaggaaaaggttcatggagcagttacgttaatatcaagtcatctcaattcataactatttttctgtacttcattacaatcattgagttgtttggttgtttactgactgtaacagatcagatgccagaaaccagaattccagcatgtgccagggaggtgacataaataagtaaaacggtccaggtgtcattgcacatgcatatgttttgtgtgattggtagggactatggcaaactggaatttcctaaaagggaccagtggttttttttttttttttttaaagcacctgaggactctgtggaaatgcctttcaagaatgaatgtaattggaggtagagagtagaatgatggataccagagtctgggagggtgagtgggatttgaagagaggttgataaattagtatgaacatatggttagaagaaataagttctagtgtttgatagcacagtagggtgactgtaatttgtggtatatttcagaatagttaaaagatttaaagtgttcccaatgcagagaggtgatggatatcctaaataccctggtttgatcattgtgcattgcatccatatttcaaaacatcacatataccccctatatatgtgcaattattatgtatcaaaaaagaatgaaggtagttatcaagtaggaattcataaagcagttctctaaaatagcacatatataaggtaatgaagatttttaaagattcttactgtttttgctagtacatggtgttactatgaagggctactaacttggccttttaagccaaattttatttattgatagacatttttcacaatctgttttattaaaaaacaaaccattcaggctgggcacagtggctcacacttgtaatcccagcacttcgggaggccatggagggaggattgcttgaggccaggagtttaaaaaaacaacccattcaacaagttacctcagtgagttatatatttcataaagatttcatctttgtgttaaacaaaaaaaatgcttgtttagagttgttgaaaagttatatcattttcttaatttaggtaaagcgtgtttatatttacattgaacatattttggctacaaccattaactctatggaatagaacattttgactcagttgctcattacgatagtctctaatgtttaaaagcttcttaaggatagttttaaagttgggacgcttaagttttggcatgtatgtagcagttaataaaagtaaaaatacactgtcatgataatcttttaagcaatgtcgatctgtacctaacgcattatagaataattttattccccattcattcactaaaatgggctgtttgaagctcactgccatccactattttttaaagtttagtacagagaaacagtatgttggtaaggatgatttgaaggaccttcagtctcctcactttttcagctatttcgaagtgtccctcagaggcatctcacattattatacacctaaataaatacacattattatacacctaaatgactttataaaactctccagaaatatttgaaattcttagtgtaagactgtgcctcagtgtgttgtttatattttaagtgtcctctttgatccctccaaggagttatctttgtaaattgcctataagattgtctttccagaaaagggagtatctttctagcaaaaggaagtattctgataaataggtaatcttaaattctcattgttagaggaaaaggaggaaaaagaaacatttattttgtttttattgtttccaggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaaggtattttagtatatctaatgactaataataggcgtctctgagtatgatcacgcttttgcagagaactgttatttaatatatatatgctgataacagtctttttcttacaaaaatgtttagtttataccttactttttccatacgataatagcctgaggttttactttcttctgttttgtcagaaattactcttttttttttttatcgagatggagttttgttcttgttgcccaggctggagtgcaatggtgtgatctcagctcaccacaacctccatctcccgggttcaagcgattctcctgcctcagcctcccgagtagctgggattacaggcatgcaccacaggcctggctaattttgtatgtttagtagagacggggtttcttcatgttggtcaggctgttcgcaaactcccaacctcagttgatccgcccgcctcagcctcccaaagtgctgggattacaggcatgagccaccgtgcccggccagaaattactctttaacagtttgataaatccttatgatggttattcagagggctaattttatttaataatgaaaagtggtatgccctgctaatggaagaagaatgtaatgtgtctgtttctctgtgcactttataggtggaattatgtgagtcacttattgtcccataactagtattcttctacctgctacttgtatttcaaaacttctaacgtgatgaattaagcaatagcaaaaggttagatttaagttcttgcctgattgtctacgtttgaagtaaggcgttcctttatttagagcagtgattttataatttcctaggttagatgttctgattttgatgacattttactcaaagcctttgtacttgaggctatgtcgtaatgattcacgggagagaatggtgcctgatacccctcgcttcaatctgcaggtggcagtcttagtaccttagttgccagcttattggaatcacatttgttgagtctctggacagtgtcttttagagtatagattgcagggaacatagttgagattcactgaatttgatgggtcaaatctagtcagcatctccctctgcgctgtttttttttttttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcaggagaatttttcttagtacagaacaaaatgaaaagtctcccatgtctacctctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcggggggctgatccccccacctccctcccggacggggcggctggccgggcggggggctgaccccccacctccctcccggactgggcggctggccgggcggggggctgatccccccacctccctcccggacggggcggctggccgggcagaggggtcctcacttcccagtaggggcggccgggcagaggcgcccctcacctcccggacggggcggctggccaggcggggggctgatccccccacctccctcccggacggcgcggctggccgggcagggggctgaccccccctcccccctcccggactgggcggctggccgggcggggggctgaccccccccacctccctcctggtcggggcgactggccgggcagaggggctcttcacttcccagtaggggcggccgggcataggagcccctcacctcccggacggggccgctcgccgggcgggcccccctatccccccacctccctcccggacggggtcgctgccgggcggagacgctcctcacttcccagacggggtggctgctggacggaggggctcctcacttctcagacggggcggttgccaggcagagggtttcctcacttctcagacggggcggccgggcagaggcgctcctcacatcccagacagggcggcggggcagaggtgctccccacctctcagacgatgggcggccgggcaaagacgctcctcacttcctaaatgggatggcggcggggaataggcgctcctcgcttcctagatgggatggcggccgggcaaaaacgctcctcactttccagactgggcagccaggcagaggggctcctcatatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagccttggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaccgaaaaccagtcaggcgtggcgacgcgcgcctgcaatggcaggcactcggcaggctgaggcaggagaatcaggcagggaggttgcagtgagccgagatcgcagcagtacagtccagcttcggctcggcatcagagggagaccgtggaaggggaccgtggagaggggagaggggagaggggagaggggagagggagagccctctgcgctgttagtcagactgcttttaaaactaagtaaaggtaatttgttaattagatggctgaaaggaaaattgttagtgcattattttatttttcagatatggattatatagctcaccatttgatccagtcctctttgatttggagatgagtggctcttcttgtaaaaatgtttataacagcagcattggtgtccagtcagatgaaattgatttatcagatgtcctttcaggtagtgatttcttttattaaaggaaattctgaatgttgtatcttggatttaagttgccatttgacttaatagattatagtcatgatgttttgtctttagaaaactaaaattccttagaacttatcatatgaattattaaaatgtttcctagaagttcttaacttcctctttccctctgaagaaaatcccagtatattaaagtcatatttgaaagggttgtgactttaattttttgtttttgttatgcatttcatttcagtgtgattttaatgcttatgagactatttaaaatgtatttgttgtagccttttcagttttatttgatgtatctttgctgcctctataaagttaaaaaagatttcctatttcaaaaatacaaaattagtaatatatacttactgtaataaggatgcacaaacaaaagataattttctgcatctgtcactttcttgaggtaagctttgtatacattacgtatatccttttatactttctaaagaatgtgtttttcggatgtatgcatgacactatttttataatctttttaagtgctaaaatttgctgtttatttttgttagataaaagagtgaccatttcatttttttcttccgtctaattgtacttattgcagatgttgttaggatacaaaaatgttagaaaatttgcaaacagattaaggtaataaccagatataagtaaattttgagagagaagttcaattttgttgaaaagtaacttatgaggtgtaataaaagcaaaattaaaaagatcaaatacaaaaatataaatgaaatgtaaaatgcctcaaccccaacctttccaccctcttaggttactattgttaactggatgtttagctatttaaacttgtttgcaacctgtattcgttaatatagtttctaatgaaagagcatactacacatactggtctgtcacttgctttttaattgcttatgctgccttgaatatatgtgttattactatttgatgacttaggctcttgattgccttacacgcatctcaccattttctgtcttctctatccaagtgatgcatcaattagaccattgtaatttatgattggaactagtaggagagactagaactggagataccaatgccttcagtataccaaaagaagcagtgaaatctgttagggtgaaagcgtaagggaaggactgtaaggttcattccaagctctgaggtcatcaagtttgcaaatgagtaaagaagactcagaacaaggaatttagaaatcatgatatgtcggccgggcacggtggctcacgcctgtaatcccagcactttgggaggctgaggtgggcagatcacgaggtcaggagatcgagaccatcctggctaacacggtgaaaccccgtctctactaaaaatgccaaaaaattagccaaatgcggtgatgggcacctgtaggctgaggcaggagaatggcgtgaacccgggaggcagagcttgcagtgagctgagatagcgtcactgcactccagcccgggcgaaagagtgagactccgcctcaaaaaaaaaaatcatgatatgtctccactttaatgtctcattgtgttgttcctcattattagtctctctacagcattttttgttgttgttgttaatggcatcagtggcacaagacagaaatgtaaatgtcattcatgatacttatatctttcttatcacccacattgaggatatcaccatatggcacctatttttccaccagtgtatgcagttgttcctctctatccgtggggaattggttccaggactcctcgcagacaacaaaatctgtagatactcaagtcccttatgaaaaatgatgtagtgcagtttgtgtataacttacacacatcctgctgtgtgccttaaatcatttctacatcacttataatacctaatacgatgttaatgctacatgagtacttcttatactgtattgtttagggaataatgacaagaaaaaaaggctgtaacagactcagccattcatttttttcccctgaatattttctgtctgtagttggttgaatccatggatgccaaacccacagatacagagagctgagtgtatgtcaagtttgctcactctgttacctcccatgatcacaagttacagtcatcttgaacccatactacaatcatagctttcacactggtctgcctacatctgttcttgcctcactttagtgcattctccacattgcattgagtatgatctttcagttactttacctttctccttagagtacttttcaggtcttcccatcttctgaagttcaaagtttctaatacagcatataaaatcctaaatgatttggctctcttttccttgccactttatcttgtgtcattgccccgtttagtcttttttggccctgtgattctcaaagtgtgttctatagacccccaaagggttcctgagatcattaaggggatctatatggtcataactattttgatgatagtagaatgatgttatttgtctttttgatttcgttgacatttttatcgattgtgaaaaagcatggtgttattcactgtgcacttgtaataaaaatgtcggtttcattttaaaatgcccttgacgttgcagtaaaaattattaattttattaaaattttaacccatgaatacacatcttttattctgagatgaatgatacatatgcatagagtacttctgtggcatgccaaagtaccatgcttgtttcagggagatgtgaagttcagttacaagctgaactacttgcttgtttcttggaataccatttttatttgcagtaatgactgacagacaaactacgcccatttgcactgcgttatttgacagttgttttttgaaaagtgaatgagaaacatctcccatagtgagcttgatagcttcccagtatgtagacttttctcatggagtctgatattagagagtgtaattttccaatactggataatgaaatgtgtcaacatttggaatatttgtatacagtggtgaaccaatattttccaaatgatcaatgcatgatgtttcaccagtatgcatgggtaaagttctttaaaagtataaaatatatcagttgatcttaatgtaacagagtttgagaagttcattggtaagatttcagataccacattgtaacctttaagaaattaccacttgtcaagtttttgaatatgcaagcattttaaaatattctttttccaactacatatttgtgttgggtcagatgttttcacccacttctgctaaaacaacattttataacacgtcgaatacggaggcaggtaggagaatccaagtatcctctgatacttcacattttaaagagatttttaaataggtaaaacattgtcacttttttcattaaattatttttttcttcagaaaacagttatttttcatcaaattatgctattttaacatttaatgggtttattattaaatgaattaatatttaaatttcacaccttgaaatttctactatggtaaataccagtaaaacaaggaaacaaaagctcttcagggtgcttaatattttaaagatatgtagagggatcttagaattgagaactgttcctctaggcatattgttctttcagttccttaaatgtgccatgtttctttgctatggggatttcactcatgttctttctgcatggcttttctgccacttcaagggagcaaatgtatgaaactctcttattcttcctatgaatcccctcattttgttagagaagcattttattatcccataacttaggactgattgccccttgacttactagtcctttaaatttctcttaagtaaaaccttgcagcttaaaaaaaagttgcgttaattcctaataaccactaacatagaatatagtcttcgtgaggactgggacttaccttttattcttctgtctcccaattcttgtattgagtaagtgtgcaataagcattttttggagcatgtgtcaggccctatgctgacccccaataagacattggaaaacaaggttatgacagtttattcttgtgtttgatagtccttcagctgttaatgacagtttttatacctccccattcttttcatctgtgaattctgttttgctttgtgatttaaataattctgtttaaatgagtgctaattccaaaaaaaaaaaaaaattgcaaagtagtgaatataatccttgccttcccaagctgcatacgcagtccctgtgaattcatttgtgttcttccctctagacttcttgctgtggttttattggtcatatagttgtggctacatggttttttcttttaaaaactacttatgctagcttaaactatttttatgaccatgaagtagtgtgcctcattctataaaactgataatatgaacaaaatacaagaaacaatgtgtagataaaccttgttaatattttgaaatgttcatcctttgttttgtgtcttatatttatgcagttgacatcttagaatgtattctgattttacatatagccaacagattaggtgatagctaatgtgactagctgatttactacttttttcaccccatttgagattgaaatttttcaccccatttgagattgaaatcacttgttactaaatgtaagtttcatgttacaggaaactaccactcatgtttctgttaatgtgaggagctactaagttgcttttatccaaatctgcttttgtagcagggaaactcgtgcctgctgttttgtcagttttcttaataccatgcccatgattcaagcactgtgtaagagttgtgtatttatatgttctaattaaaattgaagttgcagctataattattgttgtgactattgctttttaaaaattatcttcacgtgttataaaacttgtcttttgccattaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactggtatataccttcttttattatatactttatgcagtaataaagtgatatttatatatttaaacattatttctaattatgtaattttcattgctgttaagtggaaatttatttgtgggaggggcatttgggggaaatataaatcgttttatattctttcctaagtcaattcacagggttatttttccccctgtacccacttagaacagtgtcttaaatcattctgtttttatgtgtatgcactttcagaaattttttaatttgaaaaatatcaaatatgttggaaatggaagagtaaaaatagactacgtgtttctactactgaatgatgtttttgagaaggttgagatgagtaaagagggaatactgtttctcgaactagtttaaaacaaccttgaatatgtgaggaactatttgggtttgttgaatatgtgatgttcttggtgtgttaaataccttcacttaaaaattaagtttttgaccatcaatcagtggaaacttgtttattttctttcttgttttctgtgattttttttttccttctcacgtaggaagatcggtatttatttacagttacttctattgcagcataaataatagaagtctttcagttaagattggtttatgattttatatctgtattagtcactgaagggtttgactgttgtcttaacgtgattcttctgttgatggttttgtgtcattgggtaccatcttagtctcctcaacagtttaacaaaaagcaaaaacggtttgctagagaagtcgtgaaaaatataatcttagctggttccagaatagcaggaggttttaaaaggaatttatcagttctttatttgagtgtctttttgttaggaattgccttatatatccaattgtggaggtagctactaagtgaaattcacagtttatgtagtgaatatgagctttttagattaaaaacctaatatttcctttatatggtgattctagaaaggtcagaattaatttgtatttgttttcttggactatatagtcattttgtagaaacttttacatttacactagaatagaaacatgccatgacaaaaaatttgaactttcagaaaattattttattataaatcaggacctttcgtggaactgtattgaaattaattatcctgggcctggcgcggtggctcatgcctgtaatcccagcactttgggaggccaaggtgggcggatcatgaggtcaagagatcgagaccatcctggctaacacagtgaaaccccgtctctactaaaaaatacaaaaaaaattagctgggcatggtggtggtgcctgtagtcccagctactcaggaggctgaggcaggagaatggcgtgaacgtgagaggtggagcttgcagtgagctgagatcgcgctactgcattccagcctgggcaaacagcaagactctgtctccaaaaaaaaaaaaaaaaaaaaaaattaagtagcctggtttgagacaagcctggtcaacatggcgaaacctcgtctctactaaaaatacaaaaagtattgctgggtgtggtggcaggcacctgcctgtagtcccagcttcttgggaggctgaggtacgagaattgcttgaacctgggaggtggaggttgcagtcagctgagattgtgccgctgcactctagcctgggtgacagagtgagactccgtctcaaaaagaaaaagaaattaagtatcctggatttttattttattttacaaaaattcatgtgtttgcaaaaggcacataatttttaaaagataaaaggttaggtttgaaaaagtttttctccacactccccacccatttctccccctgcaaagcaagcaatggaacgagtttcttgtctttacagggctagtctgtgtatatatatgccatcacctctttatttcacccaaaatgaaactgcctaaagagagatttttattaaatgttgaggcaaagtgctgactagtgattataaggagctgaaagatgattgtagtctctcaatcctgtttacttttttgaaacatgttaatattaatataatatctatgcggaaaagtgcagaaaataattgcatagctcggcagtttatcatgatacacattgtctgtgtgatgaccaataagtaaagaaagaacatttccagcaccccaaaaggtgtcttcgtgaccacttccatttatttcttcctcattttctccagaagctaaacatcatccttttggagtagttactttttggtttttgtttatttctttgaataaccacttaatgatgcattcttgaacagtggttgagtaaggtctgtataacatagaattgcacatgtatgtatatttggtttgccttcttttcaatcctatgattatggcattaatctatatcattgcatatagacagttggttctttttcattgctgtttaggattcttttgtccgaatgcaacaaaatttatgtatccactattggtttgtatactgctgatagacatttgagttgtttcattgtggagctaatagtactgatggatatatttttgtcttgaatatgaatgtggaagttgattcactgcttcatagggtattcatatattcagcttcagtaagtaagtaacctttttgctactggttcctctttaaatactgtggagtcaaatactcagagtattgatcttgcaaatttgttgagaattgtagagggtcaaattctataaatattccatccatacttaataatgttaactctgcacttgttggtgaagtgtactctatatatccttttggtcaagtttgctagttgtgttcttcaaattctctatctttattggttattttacctgtttgttttttagttaatgaggccagtatgttaaaaaatggtagatttgtttattttttgtcatcaagttttatacactttgagaccatcatataaatttagaatggttgtgtctttcttgggaattcttcgatcattatgaattatcttttattattattttttgagatggggtcttgctatgttgcccaggctggtcttgggctcgaatgtccctcctgcccctgtctcccaagtacctgggattgcaggcacacaccactgcacctggcattagttatctttttatctttaagtttgctatttctccgaggatttacctcgtctgatgtttacttagctaacaccagccttctttggctgctatttgtatggtatatatttttccatctttttactttcaacttttcagtgtttccttatgttttagatatactttttataagtggcatgtagttgcatttattaaaaatccagcctgacatttttgtctttcaatgggagaatttaattcagttacatttaatgtgattagtgatatattcctgtttaagtctgccatgattttttatatgtactattctatttctcattgtcctgatggttggttacatgcttctttttcctccttttctgtttttagggctgattatattttttactggtcaatttttccatttttttcttgaaccgttcttttagtaattgtatcattgagatcacagtatgtactctgattccagaagtatatgttttttcccataatacattattaatgctcataatccagattatatagtctagattccagaagtatatatgaattcccatgatacattattataattttttatattcagtattcacttggatttacctcataattccattttcattgatttttattcctttgtctttgagcttttatctggtatgatgtttcttaggtctgaaaaatactcttaagatctctttttgtacttatctactgatgacacattcaattaggttttttgggaaaaagttcaaagttttatgaataatcaaatgaacaaacagcatagccattatccagattccaatatcattgttattttttcacatttgtctattcttttttctttgccaaaatacttcaaaacagatctaatatctgataattacctaaattaattataatttattatgaaaccagtgttgttgtaaacaatcagttttgcagtgtcatctgattttcaatacatgattaaacaatataatatagaattctatagggattctaagttactagttatttttactggtgatttaaaggtaatctttccttgtctcttagcttagtttgtatttgttcgaagtcatctgtcagtcttattattgctttttaaaggtcatttctcaaactttctgagattgcccttctgccctttttttgctttcagaatttttctgtgatgtttctacatgtggtttcatttgtgtttattctgcttcagattgataggacttcttgaatctttagttgatagcctcctgaagttttagctgatacctttcacagctttagggaaatagccagttaactctttaaatattgcttctgctctattttgtctcctgtctttttgagtctccatttttatatatgttgtatctcatcatcataactgatagaattttcaattgttttatctctccttagttaattatggatattttcttctaatccatcttttttttatacttgttctatcttctgctatctaatcatttatgggaaaactactctgctcccactttactgcagtgttgcctctgtagtaagtatctcatatatatatatgggtctgtttctgtttcattggtcatttatttggccttttgttaatactctattgcctttttttttttttttttttttttttctgatacagagtgagacactctgtatcccaggctgaagtgcagtggctcaatcttggctcactgtagcctcacctcctgggctcaagtgattcttccacctcaacctcttgatagttgggattatagacatgcaccaccatcagtgaatttttttatgtttagcataaatgaggttttgccatgttggctcagctggtcttgaatccctgatctcaagtgatttgcctgcctcggcctcccaaagtgctgggattacaagcgtgagccaccgtgcccagcctctattgtcttagcgtaacaatagtcttagtgtttatatctgatagtaaaaatctaccaacgttctttttaggtaggttttaaaaattgattttctaatttttttttaaaataaaactcacagtgttatgcagttatcaccactatctaattctagaacatttccatcactacaggaagaaactcttcatccattagcgttttctcccattccccccaaacccttccagtcacttggcaaccagtagattggagtttcatccatttagcctgtatcagtacattactcctttttctggctgaatattccattttgtttaggcattcatctacgggtaaagatttaggcgatttcttctttttggctgttatgtctaatgctgctgtgaacatgtttgtgtaggttttgttttgttttgttttttgtttttgttttttggtcaatgtgtgttttcagttctcttgggtatgtacctatgagtacaacctacaaatattctttttattaaagattgttgttgctattctaggtcttttgtatttctgtttgaattttagatttcatttgtcaatttctacacaaaatacttgtttttaaaatttagggcctttatgtaaatcagtttaggagaattggcatcctaatattgactttttaaatgcattaacacttgtgtgtgtgtttttctgtccccttaaatccagaatacacactggtggtatatattctataatatatttaggtctttgatttctcttggttatgctttgtggttttcaacatagttttacatttttttttttagattcttagttatatatttaattgttatgttgttataagcgatcttcctcttaatcattccattcatttggtatttgtgtataaaactataattgatttgtatatattactgtcacatctggtgacagtgctatattattaattttaaaagtagtttatagtttgcagtttcttagagaatttttaatatgttgcaatcatgttgtctattaatagttttacttttttctttctcatcattttatcgtcgttttttccttgtgttattttgtgcttcctaggtcttcctatatgttgttgaatagaaatggtaatagtagtactcatcttggtcttgttcatatatgtattatattatatatatgatatatctgatatagatatatatatctcatatgtgatatatatcatatatgatatatatatatctcatatgatatatctcgtatatgatatatatatatatatatatatatatatttttttttttttttttttttttttgacatggagtctcgctctgttgccaggctggagtgatggcacaatcttggctcactgcaatctccgcctcccgggttcaagtgattcttctgcctcagcctccccagtacctgggattacaggtgcccaccaccacacccagctaatttttgtatttttagtagagacggggttttgccatgttggtcaggctggtctcgaattccggacctcaggtgatccacctgtcttggtctcccaaagtgctgggattgcaggcatcaggcaccatgcctggcccagccctatatttttttataactagagtttttgaggccctttgtagtataaaaatagaaaaagatattgaaaactcggattgtgcaaaagatttctgattagttctatagtatcaggatggcttatttttccttggattgtttacgtcttctgtttgcttgtagtgattcacttagttttccctgtgttatttgggcgttagattttaaaatcaattaaatgtaaatgttcacagtattaaaaaccatatatattaccccaaaatacaagcatggtatgaatgatttagcaagtctaacagtttccccttgactgttgggattaatagctgtcgatttgctgtggaacacttgaaggagcagatgattttattttgggactacgcatgttttatgagatgcaattgctctgctctgctctgctctcttctcttctcttctcttctcttctcttctcttctcttctcttctcttctcttctcttctcttctgttctcctctcctctcctctcctctcctctcctctcctctcctctcctctcctctcctctcctcccctcccctcccctcccctcccctcccctctcccctcccctctcccctcccctctcccctccccttcccttttttctaactccatcacccagactggagtgcagtggcagtatctcagctcactgcaacctacacctcctgagttcaagtgtttctcatgcctcagcctcctgagtagctgggattggaggcttgtgccaccatgcctggctagtgtgtgtgtgtgtgtgtgtgtgtgtgtgtgtgtgtgtgtttagtagagacaaggtctcaccatgttgaccaagctggtcttgaactacttacctcaagtgatccacctacctcagcctcccaaagtgttaggattacaggcgtgagccaccatgcctagccaattgctcattgaccaagcttacaatgttgaatttgtgtccactaaatgaagggcacagtatgactgcactgtaatgagtggtgtttttttttttttaacataaggaaatttaattataagaggatatgtgcagtttttgttattggtatattgtttattttagcttattttttaattttattagaattctggcacaatatagcccttgtttgcttttaaaaagatgggctgttagattgcctggattttcccctttatccactacctatgagcaaattacttccctcagctttagtttcattttgtagaaaatgggattatttttgtacctcatacgtataatagtagcaacaaaaactttgcctagttagtacttaatacttttttcttgccgagattaaataagctgatgtagcttccatgcttaacactatgcccttcattggctttggcttcacatacgctttggttctgatcctagttctactgtgagtttacaggttaatttctctgagccttctttacttaatcagcaaaaaaataaaaataaaaaaaaaaaggtgggggggatcatgatgcctgggccataaagttgcccataaagtgaattgtagttattctttaaaacaatgccacatggtaatgcatactaaatatttgctattcttatagcagttatcttttccctcaatgtaactttgtagtaaaggcctgttagaaatatttatgctgttattaaacttggcaactaccttttgttttgtgctgacatattggattaagttgtgaaatgaagtttttatcccagcttttccaatatatttctcataaatattggaaaacaatgcagaaagaattatttataatgttgtttgaataacaatgaaatggaaaatcaaagaaatctgttgtagggtttcacagagcctttattactgataatgttcatgggtaagaagtgtgtgctagttttactgtgtgtgggatatgcctctctccattttggtgttctggggtccttttggtaggtgaagtggggtgtgttgttgcaataagaaaacttagtaaagcaaatttatttcttaccctcaaattgtgtaataagattactttcatttttaatgatcactttactataacaaagatatttgcaaactcatcattgctgggctgggcgtggtggctcacacctgtaatcccagcctttgggaggccaaggctagtggatcacttgaggccaggagttccagaccagcctggccaatatggcgagaccgcatctctactaaacatacaaaaattagccaggcatggtggtgcatgcctctaatcccagctactcaggaggctgaggcacaagaatctcttgaacccagacgtggaggttgcagtgaaccaagatcacgccgctgcactccagcctgagtgacggagtgagaccctgtctcaaaaaaaaaaaaaaaaaagtcattcctgtatttcctagatcttgaatgatagtattatcaatatactttattttaccattgtttccttatttatactttccagatttcttttttagaatgaaaattaactatagttttagcatcataatagtgccaaaatatttgaacatgttttgtctttaaccttttcttcatcctggtgttttttgtttttgtttttaccccttgtcttatgccagtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacaggttggagactatttggctctttgttcatgctgtctctaaacttcaaaagctgaaaaagtactttaaaaatgaccattattttcataaagaaacgtaggttgactgatctgagctaatcagtttcaacaaaaattgaggtaaagtctttgtgatatttaaattggttaaaattgtatgaatacatcttatttgatacatatttgagggaatatgattgatattttttgtgcaatcttgaagtaaatccattctctacacactcgatcaaagaatatgtacagttactagttactatttatatggagtatagttcctaaaacaaaattttatagaacagttaaatttaatgtgacttaaaattcactaataatgacagatgcttcataaattttattgtggcctaaattaggggtctccagtccctgggccatggaccagtaccaataaatagcctttcaggaactgggctgcacagcaagatgtgagcggtgggcaagcaagcaccacctgagctccatctccttttagatcagcaggggcatttgattctcataggagcatgaacattattgtgaactgtgcatgtgagggatctaggttgcatgttccttatgagagtctaatgcctgatgatctgaggtggaacagtttcatcccgaaaccagtcccctgcgcctctgccacatctccccgcatccgtggcaaaagtgtcttccatgaaactggtccctggtgtcaaaaaggttgaggaccgctggtttaaatgaaatctttggcaattccaggtgacaaattgtattacattagtcaacatgagaattcaactccttataatattttgttttgagcagatattccttatttacattaattgttctgcttccttttcaccactaccttgaaagagtcctagttcccaaatgcacaggaaattttgtgttaaacatttaaagtgtatatagcaaagcaatgatccatttatatcgagtccagttttgatttaatttcatctttaagtatgatcaatttaatcatgtttatcttcataatatatgtccatgtggtattctgccacaatttaggtaggcaggattagtctatatatgttgcttttacttcttttgcagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatggtaaattatgttttaaataggtgttggcttagacatttaaaaatatcttgaaatatactctaactttagaaggcaaaatttttaataccaactagatgtatcaagttattttcttttataaaatattacagtacatacattaagagaagaaacttattaatttgctattatggttagtagtttttatagaactatagtaatatcaatataaagttagattttttttttttccctgctctagaatccacttggttctggtctagcccttgcaatttctcatgcttcacattttcttcaacctccgcctcaccagtccattattatagagcgaatgcattcaggtaatcttttactttcttaaatttttttttttttttttttgcttagtctgccggccttttaaagactcattattcttcagttcgattttttttttttttttttttgcaaatcgcgtttcctcttgggttaagtacattttatcaagaataagcacttacatgttcaagctttgtgctcaccaaattgcataaagagtgctgttgagtaatggatttgatctatatatgaatcttgcctgctgatacattattgacataaataatttattgtagttggtcaaatcaccattatactagaaattacactcaaaatattcctaaaactagccttcttatagtagaactctttcttgagaagagcaaacagaactactgcttactgtaataactggataagaataataacatatcctaggctctgaatagtttgaatgttacctgagtttgtcttctgcttatatgctacagaactgacattgggatagatgctttcaatcacaacatatttgtgaataaactctaggcaacttttctcttaaaacagttggttttaactaccaccaacatttttgtgctttagcagcagtagaattcaacaaaatcctcagggaaataacatggttatagtatacactgtagcatgtatcattatatgaagaattaaatagtatttgcgttcttgcaatgtggttgtttcctctttgtaagagggagtttgaaagctaaaataaaagtcttacagtattttctgcccaactaatcattcattggtaacaacattagtgttgatgacatttagagtggaaatttgttattctgaagtcttatgggagatgagcagttgtttacactgtagtttgtttttttatacatagcaatgactgtagtacataagcctcctgaggaggataactatgttctttctttttttttaataatttttcttgttagggaagtattagtaactgccttgttttcttttaaactagctctgtcgagaatagcactattcctagaagtttaatttagttgttttccttcactataaaatgtagctggtaagattactagctgacccaccccaaaacaataaggaagaaaaagaattatgacattattaatgatctgccttctgttttttaattgaacttattcttgtaatgtgggtgaaatgagggatgtaaatctgctttttctttacctatctcatctggcattgagctgaagagactgggatatgtctatactgggaaaaagcattgtttgagatccattagaggaccttcccaaggcctttttcagtggtattttgattatatatgattgtagtcctgctttcactttggatctaaaccccaatgaatgcaatatgcaacttcacaggaagttaagcagggcttaaggaaactaaatcaaataatactatttggtatttaaatgcatctagttgtgaaattaagaaaaaaagttgccaatggctgaaagaagagcagattgatcctttacaaaattaactaatatactgcatttgctgatttaattttttaaaactctgatgttttaaagaagcttgtttgtatagtggttgattgccttaactgtaacagtagcagtcttactgttgtttttttgttttgttttggttttggtttttgttttttaaagagacgggtggctaggtgcggtggctcatgcctgtaatcccagcgctttgggaggccgaggcgggtggatcacgaggtcaggagattaagaccatcctggctagcttggtgaaaccctgtctctactaaaactacaaaaaattagccgggcatggcagcgggcgcctgtagtgccagctacttgggatgctgaggcaggagaaaggcgtgaacccaggaggcggagcttgcagtgagcagagatcgcgccactgcactccagcctgggcgacagatcgagactccgtctcaaaaaaaaaaaaaaaaaagaggggtttcgctgtattgcccagtgtggagtatagtggctattcacaggtgcagtagcagtctagtgtattgcagcctggagctcctcggctcaagcaattctcctgtctcaggtcccccagtagctgggactagaggcacttgccactgtgcccagctactcttaattttctacttacgtcttggggttcaaaactaacacagactgggatttcagaaaatttttgaatcaattgacaaggccatttttacatatttacttttcctcttatttatagtttagtgagttgctttcatattttaagatgagtgctccaaattatttttgagtgtatcatttggttaattgatatatttttggtcaactgtttcttctttctctcataggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaaggtaaagaactttaagaaagtaaattgatacgctttctatgtttctgacaagttatgaaaaatgaatatataattaaaaaatataactatctttttaaatacattgctcagatttttattgtggcagatgtgtatatatgtatatttataatttttcatttcagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggttagtacagagtgcaaattttaatgttattgaaactttgtattttatataatgtcttgcttataattctgtcaagaaatgtcttttcataggtgtacagataagagagcaagaggaagtaggagattagcacgttacaataacacttaatgcgtgaaaatattgtgattaattaatgggctccatttattagtacctatcaagtgggtaattctttttaatggttgtatgttaacaggtttaagagatttaattcttagtatttgtacatgtacataaagaggacattacaagaattattttgttcaatctttttttactttaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggtttgtatttggcttacatattttaaaggctgggaatatacttgatgtgatttcgctgcatgttttaggatctgtgtcaatattttctattgtaaattttggtattttaaaaaatgtcagtatttatgaaatgtctctttaggttaatctatttctccctgttattttaaacatttcttaaatgaagttgtgtgtgttttttttgggtttctggtattgacatgcacatcattgtgctactggcaaagtattaagtattgcattgaagttgaacagtgaaacttttcataaattgctaacctaatatagagctatcattttctagccaggaggtatttttgatcattacacgagctcacacattcactgacacagccatctgacacatccagctccataggcaagaaatgtaatttacttaagtgctaaatattttcgtctccaagtatgtaacagatttctacatacaaggagtaaatacattgcagaataaatagaatataattatctactgattactagaaaagaggaaagtgtatttaggcatgcgtattttaatattatacaatacatttaaataggaaagtttactgttttctttcttgtaataggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggataggtaggtcagaaaatgttggaggtatttgttattaatgatgtgtacttttcacagttactggttagcttttgaaatctttgaaatgtggatactaagttgtgaatatgaagcagatctcagagtttgtgaaatgaccagtgaagggcaccagcactgtgtatcgaagaagataataagtgataattagagtctactctttagttttctaattgaacttgtggacttcatagatctgtgtttataagtatttctattagattatgttgctttatatgctaaatgtgtttgtttgtggctaataaaattctctcattcactaagtgcttgatttcttgttaataacattagaaaatgtaaccagtagttagaaaaaaaactaattttagcttcatacctccagatacaaatcttgctttcccagtctgaaatatggtatgttttaagaaagcaaatattctatcattactctgttaaatttctatgtaaattattttaaaaattgaacaatcgaattgattcttattcttttcttttttgtttgttttgtttttagggtcttcatgttactttcctgcattggtcaaagatcacttagtaatagtggagtattagaaagcttacttaatctcttggataatttattgtcacctcttcagccacagttacccatgcataggaggacagaaggtattaagagaaagcagtgttctttagtaaaaacaatattcctgcaaatatttcttttataaaatatcttctctgaaatactttaataattatttgcagcacatttaatatttttatgatgtaagcttttaagaatgagcaaccctcatgtgattgactgccatatagttaatacttttaaaatttattccttttcattatttgaacttagtatagtatgtttttcctgtactattataactaaagtcaaactcccttacataagtttgagctgtaaggcacagttgttgttcccatcaacaataatgagttttgtttgaacacacttttttataggaataaaaacattagaacctagtttagtgctatatgaattataagttgagagttagatgttttatttcagttcctgtgaatctaagaatagtatcttataccttgctttctagtttatatagtccattttggattcagcctgcacttaatctgttcttataccttgaagtctttgtctttcattagatttgatgttctactcagtttctggctgttggtgtctattttttagacttattacatataaatattagtgttagtaatgataagatatgttttggatttatagaatgttttgtttcacttatattatcagatctaattaggaatcctaaagtcatctggatgtttttcctttgctgtcatctctctccaggagtactagatattcccatgatcagttgggttgttatgctggtgtccaggttgctggattatgtggcaactgttgaagatgaagcagcagctgcaaagaaacctttgaatggtaaagacagggagaggtttctgacaggtatcagaagtttataataatatgttggtggggattttgagtgacttcgcagttgttccagaactggctattggcctggagctaccagctgtatgtaatttaaggaaaatacaaatgaacttcactacaattctgtttaaagataacatttatacttggtggactttatagacaagctcctttgtctggacatgacttttagtttctaaatgcagctatgacttttgcaaggtgtcttccctcaggcttgtttaaagactttataatagcatgcatgtaagttagttatgaaagggaaatcagagtttttattttttcttagtatgatgtgtcatttcatttagcattattggtatctactaattaactacaaatggcctgtatttttaaatacagaaattctcagattttgagttgtaagctttctttataggttcaaagcacagaaaaatttaaaaattaaaggaaatcaacctgcaacattattttattaccctcttcccagttaacaaggctttttatttttctttatttttatttttcctcagagattcttgttctgaaaataagggtttttaaataaaggatttgagatacctaaatccagtatgtaagccattgagatatgtaagcctacatatgcttacatatggcttacatgtagtatgtaagccattgaaatccataaaatttggaattctgtacattgtcaggaactcagtatttttaagagttcccttgagatgttatagtggaatcagttgtttatagtgcatattatgtttaggaagatgatggggaattcatatgtataaggaatttgctttatattgatttttaaaaaataatgtatatctatgattagtttactcagttgtaggatatagaggtaagaaatacaattaacataaataaaactacattcatattgagaaagtcttgtctcgttctgtggcccaggttgaagtgcagtggcacgatctcagctcactgcaaccaccacctcctgggttcacaggattctcctgtctcagcctcccaagtagctgggattataggcgtgtaccaccacgcccggctaattgttttgtatttttagtagggacgaggtttcaccatattggccaggctggtcttgaactcctgacctcaagtgacccacccgcctcggcctcccagagtgctgggattacagatgtgagctactgcacctggctgagaaacagtcttgaaaaaaagaaaaatataaaataaactgtaatgtaatcttggaatataacagtattgggattgtgtttatacatgtggctactatggaaacattggtggaagagttttagggtttgaagaacttgaactaagatttgataagtaggtaggaaagagagaaaaatgtttttaggattaggaaaagatgttttgggattggaaatgggtgtaaagtgtgttattgggcccaaattgaatgaaacagaatagtctggaaatattccaaaaaaggagagtaagtatagttagacagttatgcgttctgaactatttaaccttattttggtagttattagttaaattattgagtatccttttttggttcctgattaaaagcgtctgtgtttgaaataggcaatagtagtatttgttgttgaaattgaatgacatcatcaaagttgtatagagattaatcttaattgcggaggaaaatagctattatctaaatgaaagattggagacagagggaactctggttttaaaatgatttagggtctacattagataattgacagttatccagtctttatagaatcagatcttctagcaatttctttacaatgtttttcttattaaaactgcttttcatgattgacacatgtataactgtgttttttgttttctgggtaggaaaggtactttaaaatcacatttaacagaattattaatacaagttttccttcgcctgtaggtaatcagtggagttttattaacaataatctacacactcagagcttaaatagatcttctaaaggcagcagtagccttgatagattatattccagaaaaatcagaaagcagcttgttcatcataaacaggtaattgtcaatatatttaaaaatttttaatgtttgagaatattgttttggagtttgcatgagacagatgtgccatcagatgtgaggtataacatttaatgggctcttagcttaggaaaatcatctaacactttggagacttcaatttccttaattgttaaaatgacgacaatgtatagtttacagactttgttgatgttcctttaacatttactgttatacatctctattactactattctaaatgaggttgtcattatcttttgcctagtccaaaaacctctcttcctttgttctgctttaattcaatccattttccttcatgtaattctctgtggcttttgtttgacctttggatgaaggtcaaactctttaacatggcttcagggtattcatcttctgcccctctatctagcttccagattttaattttggtttctttttccatgtcttttttctcctttttcgtgtgtgtgtgtgtgtgtgtgtgtgtgtgtgtgtgtgtgtgtgtatttttttttttttttttttgagacagggtctcattctattacctaggttggagtgcagtggaacaatcatagttcactgcagtctccaaattcctgggctcaagcagtcctcccgccttagctttccgagtagctgggattacagctgtgtgccacagtgccaggctaatttgtaaattgtttcttgtagagatggggtctcgctttgttgcccaggctgctctcaaactcctggctctggcgattcttctactttggcctcccaaagtgttgggattataggtctgagccactgtgtccggccacacaatatttttattattgctttaagatgtaagaagattctatatgaaaatccttagctctggcatgttgtgaaagctttgggcttttcaaattttttgttttgttttttatatttaaaaaattttttgatttatggggcttttttttaaaggtagacttggcaatacgttttttatttttcacttctaagtttttcagctatgagctagttcaatcctttgcaggaaaaatgagaagcattttcctcaattaccttttctttttgagacctttaaccaattttaggtagtagtaatttgtatcttttaatgtttatactcagtgcatttaattaggatacaaaacaaaacctagtgtgtctctgagtgaatatttgtctgtaaaatatcattatttgattcttcattatgaatgacagtattgggacagttggcaaaacttaaaaggtgccttgagggataattggtggtcaggtgtcagtattacttctctcattttgatggttgtaactgtgatttgtagaaggtttttatttctaggaattataaacgaaagtaatcagggcgattagtcatcaggttactaacttactgccaaatggcttagtgaaaactagttgtatttgtacaataattaaaactggctgtttcagaaaaaattaaaaatgatttttttcttgattatatttcttgcatacgttaatggtagaactttggaaattattttctgaaaatactgatttgtagaaattctcagttaacgttttaaaaattatgtgtacatgctagttttaatttaggatagagtttttttcatctatggagataacagccaagtggatttttaaaaataacgttagtgatgttttttttcctgataccaaaaacaggtgtcaggcagggctcactttgggaggttgaggcgggtggatcagttggcaccaggagttcaagaccggcctggccaatgtggtggcgtgtgcctgtagtcccagttactcaggaggatgaggcaggagaatccttaaatctgggaggcagaggttgcagtgagctgatatcacaccactagtccagcctgggtgacacagcaagactatcttaaaaaaaaaaaaaaaaaaaaagtgtcaatagtagtaatttagaaagtgttctctgagaaggaagacttaataagctgctaactcaattattattcatttataattgtggctatacctttctagtactttatatttaaagtaactttctgtgtacatgctgtatggagaacacagtcaccagattgtaaggtctttatgaacagagagttttttctcttctttggtctgtttgttcattgttgtcaactgctgattgctgttgtttagggatgggggagataggataggagggaagtgtggatatacttataaaaggatatgagggaaccttgtggtggcattttttggtattgactgttgtggatacatgaactaacacatgtagaagtgtatccaactaaatacgtacacagacaaacacaaatgagtgcaactaaaaatggaaaaataaggttggcaaattctgtcaatgtcaataccttgtgatattatcctatagtttttgcaaaatatcattagagaaaattgggtaaagtgtacaagagatttctgtattatttcttaatttatttatatatagcttaattatttcttaagctacattgtagcaaaaaactacaatgatctcaatccaaattttaataaaaaatatagacataccaaaatgtgtactactcttgagatttccataaaaacaaagctaagaaatattaagcaataaaatatttttctcatttatttaattaaaagtaaatttttttctctctattaaaaaatatatatcgctcgattatgttagtggcttatataagaaagtcttccagttatttcttactcccatgggtaagggagattttaatgaaaacagggagagatctcaaagtcaggatttgaaatgattttttaaaaaattatcatcacagttaaaattatactacatctttcaagataatgtgcattccattagtttgatgtatgaattctgtgaggagtataataatttttttgtttttaacgttgttaaagattaagttgtttatttgttttataaagcaacttaacctactaaaagcaaagcagaaggcattggtagaacagatggaaaaagaaaaaatacaaagtaacaaaggatcatcatataaactcctggtagaacaagcaaaactaaagcaggccacttcaaaggtatgatctatacttttcaatatagttatctcagaaaagtcaaggagttatgatctttaattacgatcgagaaacttaaatatacattactctgcttaacagagaagccaacctactctggacttttttttggtggggtagtttaactgaaggaaatgtatgataaatgtggtatttaagtattattgtaatgtattaccttcattgtggattgagttccagtaaattgaagataaaggatagtggaatgtatagttttgctaatgtggcattgatagagcagtttatttccattttacaatacaaaattatacaagatgattgcaaatattattgtatcagcctcacaaataaaatgtatatgtaaagtgaaaaatgtggcattctctttacccttagtattgttattggaatattttggtggctgagtttagaattgaaacttctttgggtccagtggtgctcacaaggctcaaatgtagtatgtcttttgtaagtgaaagtgaagttcaactgatttgtaagttttaaaaccttggtgtttactttttaaaattttgagggataccgtgtatgtatcaaacaagtttgtagtctttctataacatgaaattatgattattccgccagattttgaagtaactcgaattaatattttgtacttgatgttatattagttttctttaccttcaagcttttacaaattatgtttaggatgttacggtaatatttatgttgttagatttgacttaataacttaatatattatctacattgaatgtctgtagaatttcacttttctgaaactctgttacatatctgatactttactccaaataggaagtaaggtatattggtcagtttagcttttaatattcttacttttgaaacttacagtgtatctaaaaattttgctctttagaagttgtaatatggagtggatattttcattacataaatctatactgaaaaaattttcattaagtaaacattgatttaaacactatacatttttgtgtgcagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggtatgtaaactataagtgtagacttacagggttggccgggcgcagtggctcatgcctgtaatcccagcactttgggagactgaggtgggtggattatctgagtctaggagttccagactagtgtgggcaatgtggcaaaaccccgtctctacaaaaaaaaaaaaaaaaaagtgacttataggttaattaaaaactagcaaaggatgatgtttttagtcaattttcattaagagaaatgatgcctcttttggttttgcttttttgcagttagtttttttattgtgtcttaaaagatgaaaaaaattcttttcaaatttttccttaaggaaatctgatttatattttaatttatttaaaacttgagggtttgaaatgtaagtaatgtggatatgtttatctccaacctgcctttcttatattaattaaaataggaaatacacaagtaagtgtcaaattatattaaagaaggacttttgactgggtgtggtgcttcacacctgtaatcccaacacttcgggaggcggaggggcggatcacaagttgaagagattgagaccatcatggccaacatggtgaaaacccgtccttactaaaaatacaaaaattagctgggtgtggtggcatgcacctgtagtcccagttactcgggaggctgaggcaggagaattgcttgaacctgggggcgatgaggttgcagtgagctgaaatcgcgccacttcacaccagcctggcgacagaccgagactgtctcaaaaaaataaaaaaagaagaaggacttttaatgtcatgattgcttttctgtggcatattcactgttcgtagaaatttaattcttaactatacaattagatcttaaaccagattttaatatttgattcatgaaattacattcttttttgcattccatctcaagcaattttttttgataccagactcatacatcattgttgaaacctattgttcagtgctaaagtattggtagacttctgttagtgtttgaaaaaacatgtaattgctatttaagtgtatgattttataaaatgtattacaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggtgtgttaggatttttcttcatagagtatgtcaaaattaccttgtcattgctcaactaagaatcttcaaagggatctttaacccctagagggatctttaaccccctaaaagcataaaggtctgtttaatcggtgtgatgttatagcagtagcaaccattgaaaattacttttgtatttaagtatattgatagtcgcgataaatgcaaggctttagaaaggctttgggttgttaaagtgcatgaatattggagctagcctgctttattattaacatcagtggtatgctgcttactgggtggggaaatcactttgcctcattttcttcatatataacataaggataataaggataatctttgtataaggttgtttttatgaataagcgtgttaatgtatgtacagtaattaaaataactctttgtacatgttatgtgtttactggatacttgtctctagcatttgaaagtaatggagtgagtcctagcattccttacgggggtgggaactcatttgcctcagattcttttatagttagtagagcatttattctgtcagtgactaaactggaggaaaaaaatgtgctgtaatacattttcgaaatctgtataaattattaaaacaggactatccccttacatacaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtaaagttttacattatgtttcttctttattctattaaatggaaacatgtttcaaaataaagaatgttagagaaaaataaagttgatttttatatttttctattagttctttggccttataaactagatccattattttcctggtaaatacattttatcttggttctcattacaacaaaatgctataatttcataatatcctaattatgttgatatagtgtgatttggcaacgatgaagaaaatgcaatgtagaaaacatgtaaaaatacaaagtgatgaagacagcagttttaaaagctcttattctttaagatccagcatgtgatttttttggtgtatttttttcttactttttctttttttttcctttttaaaaagtatctttataaattagcatgtataatcctttatcatctccataccccttacttttcaaaagtctgttttgggtactaatctgtatatgtcagatgctgcagtcattttcaaccatttgtcattccttaatcttatgtttgctcatgattttctattttttacttgatattctctttatctggagtagatttcctgtgtgcacgatgaacacttcgttatcgaaggttcacataaagcgtgcctttctctaagaggctttttctgtcattcccagcagagttagggactttgccatctgtacttcccttgcgctctcaaatatctctgctagcacatatcatgttgtagtcagttttaattatagtgcacccccacctctgaatttctcttaatttattggattggagagttttattaatcttcatgtacttatactcaaaccctcatacaggctggcatttactaggcattctataaagttatgttgaataagaggataggaatgatggaaaagtaagagttatagaggggtacttataagggttataagaaagctacttaaaaatttggagacatctgagagacaataatttctaattcataacagaaaaataaggtaaatggctttttttttttttttttttttttttttttttttttttgagacggagtcttgctcttgtcacccaggctggagcacaatggcgtgatctcagctcactgcaccctctgcctcctgggttcaagcgattctcctgcttcagcccctggaatagctgggattacaggcggccaccaccacacccagctaatttttgtattttttgtagagacagggttctgccatgttggtcaggctgttctcaaactcctgaccttgtgatctacctgcctcggcctcccaaagtgctgggattacaggtgggagccaccatgcctggccggtaaatggcattcttacaacttcagtcctgtttgcttttctctttaatactgggtaacattacctgtaataatgaattacatgttagatgtaatagaatgtatattatttagtaatgttggtaattatttttaatagcaaagtttatgcaacttacttcaataagagctaatactgtggtcttttctctaggaaagcaaatatcaatgaatctttgtttttatcgtgtattatggagcgaaatgtttgcatacatagagtttttttttttaggcatatgtaacatgcaagtaaaataactttttttaactaaaagcattatgtcatctaaattttatgtgatacactccaccaataagatcacttttaattatttgaaggtgcacctcctctgtcctctttggaaaaagataaagaaattgaccttgagttacttcaggatctaatggaagttgacattgatcctttagatattgatttggaaaaggaccctcttgcagccaaggtttttaaggtatgatacatgagaatagtctttgaaaggaggccgggcgcagtggctcatgcctgttatcccagcactttgggaggccaaggtgggcagatcacaaggtcaagagatcaagaccatcctggccaacatagtgaaatcccgtctctactaaaaatagaaaaaattagctggacgtggtggcgggcacctgtagtcccagctgcttgggaggctgaggcaggagaatggcatgaacccatgaggtggagcttggagtgagccaagatcatgccactgcactccagcctgggtgacagaacgagactctgtctcaaaaaaaaagaaaaaaaaaaattctttgaaagggaagttttcagtctcatacttttggcttagtaattacttaaaagaggaaaatatacatacattaccactaatgcaactcattattcagcattttcaaaatgaaattgctataggtactactattgtagtttaaaaacaatcaatggaatagtataaagaaaacttacatttttattaatgtagctactcataattatcatacaataatgagaactacatttaagtatacagaagtatagttatagatcaccaacatttcagacagccatctaaacttcatccgagctgtgttcattgcagagtctacttgtatgttagcctacttttttttaaaggagaatcacctgtaataatttatggtggtacagttctttggtccataagagattttattagggatgctactttcagtttctaaacatataaggtatttttagattttggcagaaagtgaggagaaaattactggaccattcttataaatcattaaaattataaggggatttgggaaatttaaagggtggatagaatatttattttgtagttctgtttgggtttagataatgtaaataacgtgtcattcagccaagaggcaaaaataaaccacagttttttttccattcttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcagggtaagtgtatgtttatattttaagacatatgctattcttaaaacaagtctgtcatttatgtatactttgtcccttgagaagttgagcctgggtgtatgccagtgggtttagtatcacagctgtgccgtgagtaccattcagagctgtttctttgtagtcactttagaggaacttctatctttttggttctctgtcagaataacacctagcaagtgttgtatgggattggcaatgattttaatgaactgtgctgtattttaattgttgactttaatagtaaacttgtattttatttataaagagaatgaaactacattaaataagtattatttttgcagtttttttttttttttgagatggagtcttgttctgttgcccaggctggggtgcagtgatgtgatcccatctcaccgcaaccgctgcctcccaggtcgaggggcttctcttgcctcagcctcttgagtagctgggagtataggtgcatgccaccaagcccagctattttttgtatttttagtagagacaggtttcaccatgttggccaggctggtctcgaacttgtgacctcaaatgatctgcctgcctcggcctccaaaagtgcttggattacaggagtgagccaccatgcctggctttatttttacacttttttagtcatgtagaatatatgagatgtgtttaattttttaataaaatacattttttcccttttcaacgctgctccttctgttataaaatattttttaaaaatttgaaacacacatttaccagaatgtttcaagttaaatgcggagaatgtttattctctagaaccatttgagagtacgttggtaatttgatgtcatttttgttttgttttgttttacaaatcaggacattcttccatatatacatatcaagaagtatattccctcaaaatcaggaaattaacgttactgctgtcaaatactgagagcccattcaaattatagcggttgtcaaaataatgttccttatgcacaagagcccagggaaaataatgcattgcatttaatcgtcacgtctctttagtctcattcagtctgcagtagttcctcatagttgaccttcatgacattgatacttttgaagatggcaggccagttattttgtagaatggtcctcagtttgtgtttgtatgctatttccttgtgaatagaatattgagttaatgcatcttcgaaggaatattccacaaataatgctcccccccaacatttcattcaattagggtggcccatgattttgatctctctcattattggtgatgttaagtttaaccacttgatgaatgagttgtcttctgggcttctcccttgtaaagttattcttttcccctctgtaaaaatgttttgttctcattgggtttttgggggtacacacatggtcttgctctgtcactcaggctggagtgtagtggcatgattttcagttccctgcagtcactgcctcctagaatcaagaagcagttcaccattttgaccaggctgttctcaaactcctgagctcaagcagtccgccctcctcagccttccaaattgctgggattaaaggtgtgagccattgtgcccggctgctgtaaaaagttttttgggggctggggagcagaatggtactcggaaactataactatcctgttcctcacaaagtttctttttgaaaaaattactggccaggtgcggtggtcacgcctgtaatcccagcacttgggaggccgaggcaggtggatcacctgaggtcaagagttcgagaccagcctggccaacatggtgaaaccccatctctactacaaatataaaaaaattagccagacatggtggcgggtacctgtaatccttgggaactgaggctgaggtaggagaattgctataaccctggggcagaggttgcagtgagccaagatcgtgctgctgcagtccagcctggacgatagagcaaaactccaactcaaaaaaaaaaaaaaaagaaagaaagaaagaaaaaattactgtaatagtttattcgttcagttttgaacggactcatggttgcctttttttattcagtgaattataccttaccatttttttaaattgtggaaaaatgtaaataacataaaatttttcttttttatttgttgagatagggtctcactatgttgcccaggctggtcttgaactcctgggtgagcccagtccttcaaccccagcctttcaagtagctgagattacagcatgctgtaccacacctggcaaatttattattttgaccattttttgtgtgtgtatagttcactgttaatgaagatattcacaatgttgtcatctgttttttgatgttcagattgtctcaaatttgaccaataggatcccccttgagattttctcatcattttagcacttccttgttctctggcaaaacatgatagcccaggctcatcctttactttaatctgccccaccccgggaattagtcacttcttaaaggagcatggtatttcaaaaccttttaaaggagaaatgtggttaacaaaccatgatttcgtcatggatatatgtgttgctattttgggactgttttcatttcctcgtggtggacagagctagggagtatgtgtttgtgtgtgcgtgtgaacacacacacttggcatctatatttctgtatctgtctatctattctgaatatgatgaattcacatcagtgtatctggatttaatctaactccatagggttcattttagctttcttcttgtctgtatttatagcactttattctgacagtgagaaacctggttctcattatccttaatgtctttgtttccattattgttacttcacttatttaatatttctgtctctatataaccaatcgcctgtctctaccctcctttccacagatattcttcccctgctgtggctccgatactgcatgttaggtggctgttctgtaagaacacactcttcatcctctcttgggttcagatgtcatcattttattgtaggaggtaggacatgagtaataattgtcaatgttttctttttctttcaattgctttttgtagccctggatgctcgcctagaagttggacttgaacagcaagcagaactgatgttgaaaatgatgtctactctggaggcagattccattttacaggcattaacaaatacatctcctacatgtaagtaaaatgaccatttttagagtattgcagtgaatgattcagctcttcatcattttcaggtggattcatcaaggacagatttttaaattccatgatgtgagtctgaggggacttagtatgtagcactttcctggctccgagttagtagcaagttgaaaactaagacaaaggattaacaaatgcagagagtatcatgcaaaatacttccatgtagtgctgtcagttcagtgcagaaacctccattgtgttttgtttactgtattgttgtaaggttaataaaattcctacagaagccttcatacctgcctgtgagttcattgcactattccaaatttatgatgaagtagattttttgtagtaacatctttatcatccttaaagactaggatagagaatatagtgtaggatgacagccaaataggcctgttagttgaaagccagaattgagaggatttactacctaataacctacagaaaagaaaggccaactttttcgtaaaggactaatagtaaatattttaggctttccttgccatatggtgtgtattgaaactactcaactctgacttggttgcaggaaaacagccatagacaatatgtaaatgaatgggtatggctgtgttacaagaaacaggtagcctgccagagctggccatcacattacggtttgttttccttgatgaggtctacacaagtctggaactgggtagacctcggaggagtacagttgaaatagcacggtgtttttcaaggacagattggggagctgtgcttagaagagggtgctggtttttgttttcttaggcctgcatattgcttcaccttctctaggtcagagtgaagaaggggtagagatagtaggtagaaccgaataaaattacagatgcttctcttatggagagttcacaacccatttcaatagagaaatttgagtttttacatcttccttatgttaaattgaattctttcagtctgcaatcttcatttgtttcttgctttagagggtatcaaaagaagggaaaaaagaaaaacagaaggaatggtctagtgttctataatctcagtattggtacacaaatattcttgtatcttatctcccaggcaatatggggatcccttttgtagggtccagtgtctgcatgattagagataactcggtactgcccaaagtaacccttttctttgttagacatttcttatttaaaagcacttattagaatatcttttcgtaattctgaaaggatatttgaaaaaaaaaagaataaaaaagaaaatctgtttgaaattggtgtctcctctttatcttttgattatcctgcacacagctgtctctctttttagtataataataaaataaggctctaaatatatgataaagctcttagtatccttgtatttctctggttcccatgaatatattctcatttaattagttttgtgtgtaacctgggcatcagaacttctgaaagctccccagatgattctaatctatagtcaaggttaaagatgaatgaactagaatctagattattctaaaactaccttatcaataattagtcaggagtcttatttctttccctttactttccctcctttattaattggaaaaaaatgcaaataaaaattgctagaaaagttctttgcctttttttgttggtttgagtcctatgaatttgggaacttctctctttggtcattgtcttttttactttcaagtaatgttataaaaacacgtttttcaaatactaaatattgttttgaaccattctaaagaatgcagttttaatttttaaaaacaatttaacctatttatacatatgaataaccagttaacacatatcctgatactttatgtataaaattatacttgtgtttaattttcagtatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgaattcaggagaaatggtgtatttttacatattattgttagcctggtaaaagatgaaactaattgggaagttcattctaatcctgtcagggatgatttctttattatattcagttggaaaaatattagaaatactttgattaccaaagtaatcacagtttctcaatgatggaacattgataatttttaagatttttagcttcagtactttaattcctactacacatacacacagctgtgattagagattgaatcacagggcatggtggcttgagtttgtagtcctagctactcaggaggctgaggcaggaagattgcttaaggccaggagttcgagaccagcttgggcaacataacactagatcctgtctctaataaagtaaaaaaaattaaccaggtgcagtagcacatgcctacagtcccagctactcgggaggctgaggcgggaggatggcttgagcccaggagttcaagatatagcagaccttgtctcaaataaaaaaaaaaaaatgacttgaatcacctgttttaatttagaagaatctttttatgaggtaatttctaacatttaattcaggtaaattttgtttcttcaagaattttaagatgtgtttgctgatcaactaatttaattaactagaagatgcttttaagtgtgaagaagtgtttaatagaaaaggttatttactcgtgacaagaatttaaacataagatttttgtttaaattgtatttcatattataataggtacatttttctcctgttgattttcattctttttcagttggagtcacttctccaattgtggctcacactgagcctgaattctagttcaactggaaacaaagaaaatggagcagacatatttttatataatgctaataggatacctgttatttcattaaatcaaggtaagatttattaggagaaaaacattatagtctaaatagcaagcttaaaacgtaattattaggttaaaatatacctaatctttgtcattaggggttataacattctagtggggaaaaaacagaatacctttttaaaaagatgcactaacttaccgattagcaggaaagatacagggagaccttgttgagaatagaagactcctactctctggtctgtggtatgcctgtatgcaactaaaatttacaatgttctgttactcctttatattttcttgaagttttgtctgatctgtaaaagcaggtcagttttttattatttttttttttcattttttaaaactatgagttagcccctggaggagttagtcagctggagaaggtggtcagtttcctgtggaagttgtgtgtgtttcttggcaaaatatgagtatgggaatggtggtagtaaaataatacaacaggaaaagaattagcgttcagctctagctacaggaatctattttagttatatttaaagaaaaataaaaatgagaatctgttcctgatgctttctctctatagtgaggcatcctgtagcttgcttgggtcttacatggtgtattttccaatgtgagtgccagctccactgagtcacgcacagattctacttacatctgcactgtctcagcaccagccagcccttctttaatttataggtttccatctcttcaactatattattattataataaaatttgttttcatctgtttttaattttattatgagaaatattaaatatatataaaaaataaaagagtaaaaaatagttattcctggctgggcacagtggctcacacctgtaaaaccagcactttgagaggccgaggtgggcagatcccttgagggcaggaattttagaccagcctggccaacatggtgaaaaaaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacatatactttagtgttctactattggattcttaaaacagagttttccaaggagtggtatacttgtcaaagtggttgagttggccagatgtggtggctcacgcctgtaaacccagcactttgggaggccagcacgggtggatcacttgaggtcaggagctcgagagcagcctggccaacatggtgaaaccttatctctactaaaaatacaaaagttagtgggcgcctgtagtcccagctacttgggagggtgacgcacgaaaatcacttgaacctggaaggcgaagtttgcagtgagcttagatcacgccactgcacaccagcctaggtgacagagtgagactctgtctccaataaaagtgactgagttttttcttctaacatgtctcttctgaattagttcttatatatcctttgtgcttgtttactttgataatatagtctcatatgtctcgttggatgttcaaatcatattttttaccttttaaaaactgattaaaagaaaattgattgcttttagagtacaaaggcaggtttttacatttcatctaagtttttatgttattcttttaagatacctttgtacttaaaaatgatttattcattattatattcataaacatgcataactagattcctgggttttgtttaataatttaaatcattgcttagctttaaaatgctattatcttttttcatttggaatgtattttccaaaaatgagatcaaaagcatcactgtgatactgaaggtggatttcatgcaaaggatattttattcatctcagaaaactgttgtgttacctgtacgttagttcacagttaacctgtatacaactaacatgcaaaaaggaataattttgctacaacttattttagaaaacttgattaaagtttacctgaaaagtagatctctgactgtttctggaagggggagttagttagaataggctttccaaataagagtcaggacctagttatatcttttctgtttgactgtactaaataagatgtacattaagctcgaggtgttttcagaatcagaagggggcagaagagatagatggtagatagagagggaagtcctgcttagtcaatatagtagaaactgaaacccctttaataaactgtaattactaggaatgtatgaattttccttggaactaaaagatgctttcagatactgcatttccattatttcatggtccatttcttaagaggtttttaaaaaatgttttatagctggttccagcagtgccattggaactcaggagagtactgctcatttgttggtttcagatccaaacctaattcatgtattagtgaaatttctttctggcaccagtccacatggaacaaatcaacacagtccacaggtaatatgatgtttagcctggcatatgcccagactattcaataaacagtattcgtaatgtaaagctatgtaacttttttattgctaaagtattaaataatagccttttatgtatcaatataataaaaaaggttttgttatttgtaataatagctatactgacactaaataatagcaggtggtaagttaacctcttagaacagtgatactaggttttcatatagatacatatttttggcattaattttggataattggaaacattctgagtaaatactgcaaaggtagagaagcatttcaaaaattttggaatcaataaattttaatatgtcatatttgattacttctactatcaagattatcaattcaccttaatcattttatgatgttaatgattttgcttagcaaaagataacaatattgctcaggacttataaacattttctgtttcactgtaaattttcctttatatcaatttaatttcttgttatgttgtactgcttctgtgtaaatatttgtacttcattatatttcttttaaagtaaaaatatatttagcatttataacatcttttaaaatcaagattattcaagattatcttgcaagtttatcattttaaacttcttggatttgccgtcagataaattctaatttagttgtcctcaacagcccagtttctctattaattcacttattcagtgtttaggaggcttctgtgtgcttgttctaggtactagacatacagtatttaccaagatcaaatatctgccttcatagagctttagttaatactctaatacttaatatattttaattttacagatcttaataaaataaatgagacaaggaacaagtaagagagaagaaactaacttacagttagattgggacagggttttggtaggggcagagacatgttatcaagtgattattgtacttaaagattgattgaatttcaaacaggaagactcctcgggatcaccaattctgacttaattgttttacatgtaagaaaacatgcatcagctatattgccccaaattacataactagttatctgtatagctaggtatcagtgaacaaggcattgcaaaaaataatattttctttctgtttttgaataaaagaaaggaggaaataactttttaaaactttttaagttactgaagatcaagctttcctactgataccttggttttatataggaagttctgatacgaaagctataatttgtatgctcagtatcagaaattaactttatttaactctaaaatagtttggaggattatattgtattttatttttccagaactactccaaggttttatgagttgttcatcaaatcaaattaggatcaaataaaataatatgtagaagtgttagagcacacttctacctcaggttacttaatgtagtgttcactatcatttctttcattgatgaattagaagtttgggaaagcagttttttttttttttgacttggtataaatttatttttatttagtttttgttttgtttttcacttagcttaatgcttgctttgctagttgttagaaacatgaccttttatggatcattttacctctctgctcctgagttatttgattttgaaatggggtaattaagaaggttatttgtgaaaatctatgttgaagttatttatactctaaaaagcattataaaagtatttattgtgtaattcaggtgaactttttttagtattgagttcaataaacctaatatagttgtggtgtataaactataatgaaaaagtattaacagtatttttatttgcaattcaaaataaatacatcaagacctaaaaaattcatttcctgctatcattgttaatacttttgttttcctcgtacgaaaagttacagtgtatagcttttgactttctacttgataatttttaaatgaatgattttttacatgttaccagtaagcagttttcagtgaatatacatttctctttaggttggtcctacagctacacaagctatgcaagaatttcttactcgattacaagtgcatctttcttcaacatgtcctcagatattcagtgaatttttgctcaagctaattcatatactttcaactgaaaggtaaatttttgtgtactaatttgttcctgatatagaagtaacatgtaattctccaaatatacttttctttaacatttgttgggaatttatctgtgaacaaataagcaggaggacggtagtaattaagggggaaggatatattggtgtgtttcctgattgtttccatttcatttcattatggttttctcaagtccttatacctctactctctttaatatgaaaggaatacagttgacttgcttttaatggttttatagattagttattataagctttttaaaaggtgaaatttattttgaagctgtttaaactctaaagctaccagtgattttgtatgtaagaaaacctgaaaaatagagcttataaaagaaaattgtatactaatcttgtgtagaaattctaaataaatttattaacaaaatcagactccatgttataagaataaattttgaccataatgggttgattattataatgcatgaatgcttcaatatcatatatctcttattaatgtctttttttattctatatttcttaaaatccaacattactttctgatgaaaacttttttttttttttgacacagagtctcgctctgtcgccaggctggagtgcactggtgcagtcttggctcactgcaacctccgcctcctgggttgaagcgattctcatgcctcagcctccccagtagctgggattacaggcacgcaccaccacacccagctaatttttgtatttttagtagagacggggtttcactatgttggccagggtggtctcgatctcctgacctcgtgatccgcccgcctcagcctcccaaagtgctgggattacaggtgtgagccactgtgcctggccgaaaagttttaatgaattataaagtgttattttgtttttgaagttacaataaaactgagtatttcaaaaaaatccccattaatataaggaatagggctgggctcagtggctcacgcctgtaatcccggcaccctgggaggctgaggcgggaagatcgcttaagcccaggagtttgagagtagcctgggtcacatggcgggaccccttctctaaaaaaaaagaaaaagaaaaagaaattagctagggtgtgggtatacacctgtaatcccagctactgtggagcctgatgcaggagattgattgaaccagtgagcccaggaggtggaggctgcagtgagtcctgattgtgccactgcactacaacctgggtgacagaacaacactctttctcaaataaattaatgatcaggaataagtcagtagtgactattgccacttttttatctaattttattcaaataaacagtatttatacatactttgtgaggattttgtgaaattttgaatgacataattaaaatcccgtgaggaataaagattagtcatcatttgttttatttttcttttaactaggctttttaattttaactctgcaggctttagcataatccgatccacagagttcacaacagtgaagattttcatactaaacttttaatatatttgctctaacattttctaaaggattattaatcttgtttgtagtttagtcacatctaatatttaagcagagatattttgaggtttatacgccacagaaactgtttaggaattttctccacctcacttcaccacacatataccctgtacatttttgtggcctagtttatttaagagggtccacaaagctgtggcccaagaagaatgttagtttatgtttgtttttaataaaggctctggtattctgtgaaagatccagcagctctttagttagattaatgatataataatatacactgaaagaaatactcggtataaagaaggcattcagttttatcagatgagtgttttgcaaatactatctattggtctttggactctgttttcactttattaagtagccttcaaaaagcagaagttttaaaattctagatgtaatctaaattgtcaacttttatgtattttttgttgttgttaccctcctcacacaaagtcttaaataccctcctcacacaaagtcacacagaatattatgttttcttctagaaattttacaattttatgttttatatttaggcttgttattttttgctttcaggatgaagtttttttttttttttttttttgcctgtggatgtccaactgttcctatatctttgtttctttttttgagacggagtctctctctgtcacccaggctggagtgcagtggtacgatctcggctcactgcaagcgccgcctcctgggttcacgccattctcccgcctcagcctcctgagtagctgggactacaggtgcctgccatcacgccctgctaattttgtttttgtagttttagtagagacggggtttcaccgtgttagccaggatggtcttgatctcctgacctcgtgatcagcctgccaaagtgctgggattacaggcatgagccaccgcaccccgccttcgtagaccattttttgaaaatactttccttttttcattggattccctttgtagtttttcaaatatcaatcaatgatacttgttttgatctaattcatacacttttttttttttgagacaactttgctctgtcgcccaggatggagtgctgtggcgtgattcagactcactgcaacctccacctcctgggttcgtgcaattctcatgcttcagcctcctgagtagctgggattacaggcccatcaccatgcctggctaatttttgtattttcagtagagatggggttttgccatgttggccaggctggtctcaaactcctggcctcaagagatccacctgcctccatttcccaaattgctgggtttacaagcgtgagccaccacacccagcctcatttgttcatacagtgtattatatagaatttatgtttttgtctgttttttatgcattacctcactgtcttagttcccttacagtattttttgaaatttagtagtgtaggctctccacctttgttctttatttttagagttattttggctgttttaattccattcctttttccttataaattttacaatcagcttattgattttccagaaaaaaatcattttgagtgagattgcatcattctgtagatcagtttgggcagatgtattgcttgtttggccatattgtcagagaatacggttagtttaatttcctcctttcttatgcatatgtctcatgggttcccctccccccatccagttgtactcgttcggacttcaagtatgctgttgagtacatatggtaaaagttactcttccttctttttctcaatcttaagatcttatgaaacattgtctttcataattagatatgttactagctggagctcttttttagatatgtgatagtaagttgaggaagttccagtttgtttctaacttgctaagaccttaaaaaaattatgaatgtctctggattttgttagatgtttccctgcatctgttgaaatgaacatagattgtttcttctttcatctgttcatacgttgaattatattggtgttttctaaagagttgagatctcactatgttgcccaggctggctttgaactcctgagttcaagcaggctttcagtctcattctgttcttagctggcccaatcggcatatgccactacaccaagtttgattttttttgctaagtgtcagttaatgtgcattctcaaggtagacacccttggtcataacatatcagtccattttataacttgctgaatttattctctgaatttattctgaaagaggttgtgtaatatgtgtattgtcacttacttaagtatttggtagcatttgccattgaagcatcctgtggctagagttttctttgccccaaaaattttcaacttattttctaggtcttggactattcaggttttctcttcttgattgagctttggtaattttgtgaaggaagttgttcctttacattgttgtatttgttagtggaaatatgtatatgtattaatgtttataggatctataagtttccttcatttctgatgttggtaatttttatctttttttggggtcattctggctagaagttcatcaatattatttcaaaaaaaggcagcttatagattatttcttcttttctactttctttgaatttaatttgatctttatggcttagataattgattttagacctttcttttctaatacaagcatttgacaaagtcagaattggtctatatagactatatagactacatacatttaatgtaattattgacatgctggattaaaattgatcattttgctatttttctatttatttcatctatttttgattccttttaagaaatctttttctgttgacttttgaattaagcaacttttaaaataatttcatttccatccttatttataactgaatttcttatttatttttgagacagtgtttgtttgctctgtcgcacaggttggagcgtagtggtgcgatcttggctctctgcaacctccgccttctgggttcacgtgattttcgtgccttaacttgccgaatagctgggattacaggcttctgctatgctactacacacggctaatttttgtatattttgtaggcgtagtttcaccaggttggccagggtagtctcgaactcctgagctcaagcaatccacccgtgtcactggcattacaggcatgagccactgtgcccggcctataaccgaaaatttttaatattagttgtcctagttttacaagatatacctttatttaatcacattccactttaaaatattattccgttcatgtataatgtcagaacttaacagtgtagtttcagttcctttcttccgtcttttgtgacatagttgtcatgtttttactgtttatatatgctataaacacaatactgtgcaaccttttttttattttttatttttttgctttagacagtctttgtttgttttttgaaatagactttcgctctgtcacccaggctagagtgcagttgtgtgatctcaactcactgcaacctcctcctcctgggttcatgcaattctcatgcttcagcctcctgagtagctgggattacaggcccatcaccatgcctggctaatttttgtattttcagtagagatggggtttcgccatgttggccaggttggtctcaaactcaaaagtattcttttgccttagtctcctgagtagctggaattaacagtcacatgccatcatgcctggctaatttttgtatttttagtaacaatgaggtttcaccatgttggccaggccggtcttgaacttcctggcgccacaagtgatctgcccacctggggctcccaaagtgatgggattacaggcatgagccactgcacctggcctaatttgcctttttcttgctgttagactgacttgctgttagacttttcagcattctatatcttaggcataaacagaatttgaagagcattcaattttgatacttgagaatgatttgattgaatcttaatttttatgtatcattatcagtaggaaatgtttacaatagcgttatttgagaatggaaaaaattagaactcatttcattataagaagtgccttgtgattttgaagtatttttgtctgtagcttcaaaatcacttccggatatacttgtcccttagttttgtatttggaagggaggttgtttttgagtttgtctaaaatggaggcaagaacaagaattccaaaagagatgaaaactattagctacctaatgaaatagtgaatatcaagaatttgtttaactttcttgtattgtgataagttactactttcagaactacttaaaatcgtttaatttttaatcctttctcttgttgtatctctctctctctctctttttctgtctctctctctctctctctgcaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggtatgtattgagaatattaatcttaccattgtctctgatactataactggtttttttttaagcaatatatggattcattttctttttactttatagtgtaaaactgctttaagcttttcatgactgatttttattggtgaggacttctgtttaggggcttcaattaatgaatgaaagtgaaatattgacaaatgtcatgtcagtttggtttgttttctttttattgagatgcctcccaggttcaagcaattctcgtgcctcagccacccaagtagctgggaccataggtgcctgccaccacacccagctaattttttttttttttttaccccgagccagagtcttgctcccacgctggagtacaatggcgcgatctcggctcactgtaacccccgcctcccagattcgagtgatactcctgcctcagcctaccgagtagctgggattacaggcgtgtgtgccaccatgcccctgctagttttttgtttttgtttttgtttttttttttttttttgagatgaagtcttgctctgttgcccaggctgaagtgcaatggtgtgatctcggttcattgcaacctccgcctcctaggttcaagcaattctcatgcctcagcctcccaagtagctgggattacaggcatgtgccaccaggcctggctgattttttgtatttagtagagatggggttatgccatgttgggcaagctggtcttgaactcctgacctcaggtgatctgcccacctcagcctccgaaagtgctaggattacaggtgtgagccactgcgccctgccaatttttttttttgtacagacgggatttcaccatgttagccaggctggtcttgaactcttatttcacatcattttgtgttgaagacaagtattatttgttcacatttgctttaaaaataaaatgtaaaattttactcatactgtaacattttctatgacacaaaccagtgttaaatttatatgctgttgcttaactcttttacctcttggaatgttaatacattacattaaatttttaaaataaatgaacatttgtatactgtggcaaaatccttttctaatatatttttgcctgttggtatttttttctttgtcagtgtgtgagaaacagccacatcttctgtttgattagattaaaaagaatagttacatgctggtatcacatatttttctattcatgtcctctcttcttgatgtatgtagagtgatgttctcagtcatataacagaacaacttatttttattgttggtgatatagaggtattgtcatgtaagaagatagccataaaccgtgctctactgaatattgtcattgatattttaatctctaagagtccattcgggttatgtgtagagggtttagacagctattatatattcattcttcagcagttttggaaaaagtgacttttcagcttctatattttaattattatttgtttcaccatgttggccaggctggttttgaactcctgaagtcaggtgatccacctgcctcggcctcccaaagtgttgagattacaggcatgagccactgcgcctggctggatatatatacttttaatgtggtatcttttatttttcttaggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaagtaagttcaagccaacaacagttgcagtgattcaaataaatttattgcgatgtaagtggaaaattacaggacaaagataaataagtatatttattatatatcggacaatgaaaagcatcagtacaagagggctgtggattattaataaaagttggagaataaagtttctttgaagtggtattttcagagatgaccacagtgatataagagtaaaacatttaatgtgttcctgagttttagattttttaatatagtctcaagaagttcttctctttttcctaaaagtagcatagtgtaatactgaggtgttctccatagatgttatgtaagaagaagtaatgtgaaatcttttgaaatttatgttgtgtattcagcttcttttttttccattaaaagagattaggctaattaaagaaaataggttacaaaatttttcctttttgtatttcatttttacaaatgaaattgtaggaaccagattattttactttcttgtccatttcccattttgaaatgcagatattagaacagtttcttatgtcttttatatagcagtgtataattatcatttttgtaaacatttgttgaatgtgtatatttctctattagaaaatacaaaggtactttaaatggttcaaattttaaatgaaattggtgtctaaatgcatattaagagaaaagataataatggatgaagacacatgctttaaaaaattctctgagttcagggagatggtttttttattcaggtaagatttcttatgtattttggcagacattttgtatttagcgtatttaaggctgtcagtttacaaaaattaactaggaaggaatattacatgcattgagtttagttcttattcacaggaatatataaagtcataatatgcatatttcattttttagggctctcttgctacttgccagttatctgagccattattgtggttcattttgagagtattggatactagtgatgccttgaaagcatttcatgatatgggtaagataatatttcaataactatcatttaagtgtagttatgtgatagtatgttacattttcatttttgtagtcttttgtggaagtttacttttgatgttgaaccatctgtcctgagatcgatttcatttcatattctttataaatttaggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtaagaaaagtgttactaaatcttacttatgtgaaattatctagtttattagctggtatgaaacaaaattagttgaagtcagttgatgatgttatatatcactattttaattacaaacagtttattttagaggtagtggatatctcgacattctacttatgagagggaatgctttgtttgtttgtttgtttgtttgtttgttttgagacggagttttgctcttattgcccaagcaggagtgcaatggcgtgatctcagctcactgcaacctctgcctcctgggttcaagcgattcctgcctcagcctcccgagtagctgggattacaggcacctgccaccacgcctggctaatttttgtatttttagtggagacagggtttcaccatgttggccaggctggtcttgaatgcctgacctccagtgatccacctgcctcggcctcccaaagtgctgggattacaggcatgagccaccatgcctggccgagagggaatgttttaacagttctttagcagtaaagtttgtttttatttgtgagtctaaatagaagcacaatttaagaaactaaacagagattcttccgtaagttttctctttaaatgttaatcaattttaaatctcattttccttcttaaagtggtgctgtgttttgttttgagagagtctcactctcacctaggctggagtgcagtggcacagtgtctcccgggttcaggcaattctcatgcctcagcctcctgagtagctgggattgcaggcgtgtttcaccacactggggcggggggtgggggggtgtttgtgtgtgtgtgtgtgtgtgtgtgtgtgtgtgtgtgtgtgtgtttagtagagatggggtttcaccatgttgtccaggctggtcttgaactcctggccccaagtgatcccccaccttggcctcccaaagtgttaggattacaggcatgagccactgtgcctggccttaaagtagtactatcttttttaaaagttttgaatttaggtatttacttttttatctagtttacatagtttcttttaaatttttcttttcatatttctaaatcatagacattgacatcttagaataaagatgatttttttaaaggtgaaggatatattggacattgttttttacttaaagagtttgaggctgggcgcggtggctcatgcctgtaatcccagcactttgggtggccgaggcgggtggatcatgaggtcaggagatcgagactgtcccggctaacacggtgaaaccccgtctctactaaaaatacaaaaaattagctgggcgtggttgcaggcgcctgtagtcccagctactcgggaggctgaggcaggagaatggcctgaatctgggaggcggagcttgcagtgagctgagatctcaccactgcactccagcctgggcgacagagcgagactccatctgaaaaataaataaataaataaataaataataaaaaaaatttaaaaaaagtttgaaaattattgagctacgtttattgctgtgtctttagttttcgtgtatcatatgagtacaaagtagacagcagttaataatgaacttgtcaccttgccagttgacaggatttcctcatgttttgtgaatacctttacggtcatgcttaggatactaagtgcattaccagcatcaattgttcatgttttcaattaatttttctagtttaattgtatttgtatagattttaaagctttattatgtttcttttgcaagttcttataatttatgtaaaatatcttctctaggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaagtgagtaatattttataaagaagcatcatgagaacaagctttaatttagaaatatttgaaaataaaaatgtttagtaagcggaaatacacttaggtgtgattaccagagagtgtaacttctgaacagtttttattgaaataattaatactaccaagtcattttaggagaaatgactgttaacctcagacaaaaagattatgtaatgaagtctaaacaaatatgttccagttatatattatttcgctttctcttttctctcaaatttactaagcttcagtattaagctgaaatgagttcactacacacccattttttaccatgttagttttttcagcccagacctcagtcctagccttgtaatgtgaaattagcatagatttgtgtgcctgccctccaacttctttacaagataactacctttttgaataatattatattttgactacttcagtgtgattttaagattcatactgtgtttattgtaatatgtcagtatccttgtaatattgtatcattcgtttgttgcatgttcattgaatacattttattgaactttgtaaggcaaataattcaaaataatttttacaaaatactatcacttaagagcgtgaactctttcaagtatttataaagaatatgaaatactcatttgcttttttttttgaggcagggtctcactctgttgcccaggctggagtgcagttttgatatatcactgtagccttgacccctgaggctcaaatgatcctctcatctcagcctcatgtatagctgggaccacaggcatgtaccaccatgcctggctaaatttttgtatttttttgtagagacggggttttgttatgatgcctaggctactttcaaactcctgggctcatgggatctacctgccttggcctcctaaagtgctgagattacaggtgtgactactgcacccagcccattttgtgttttatatggttcacaaatgctttcaatatagttataattttgccagaattgtttaaattaatacacatgcttacatttattgattgattctcattgctatcaaatatcactcaataattgcatgaggagctgtgggaaatgttgtagattcctggcatctttggagaaaacaatttttttctatgtgtttgcaagattagactgatatagcttaattacttgtggcatccacactccttagataaaaaacagataatataaaggtagaaggaaaatatgctagtacacggtgttttaggaggtcaaaaataactatattaaaaggcaaatataagtcaatgtaagacttaggctacctctaaaattggaaagagattgcttttatttggaaagcaaaggagtttggtcataagtggtggcttttgaagttcagctggatttttcatatgggaattgaaacaggaagcatattatgaagggggaacccctgtgaaaaattaattggtttaggtgttccctacttaagtgtacttgattacaaaatttggttttattattggattagagcagaagttgaaaatatgttgtgatacagtggaaataacagtctttagaatcaaacatggacttgaatctaaggtgtgacatttcttgtgggagcgtggattacttaatctctttttgctatgtctgcttgtgtaaaatgtagataatactttcctcaaaaggttttgaagtagaaatttaaaaattaacttgactgtctagtaatcagtgtaaagctggcatgtaattccttctttttttaccactgaaattaaaaataaaaccaaatttcaaaagttttagttgacatatttattagatggggttccatgttaagctagaaataaataattttctggtagttcattggggactccttaaatttcagcaagaattgattttttaaaaaaaatcctgtggatatttggtttaatttgaaaaggaggctgggcgcagtgggtcacacctgtaatcccagcactttgggaggctgcggcaggtgaatcacttgaggacaggagttcaagaccagcctggctaacatggcaaaaccctgtctctaccaaaagtacaaaaattacctagatgtagtggcacctacctgtagttccaactactctggaggctacggcaggagaatcacttgaacctgggagttggaggttgcagtgagctaagatcgtgccactgcactcactccagcctgggcaacagagcaagactctatctcaggaaaacaaaacaaaacaaacaaaaaaaaatttctaaactcagctgtgaggttaaactcaatgtttaaaaaaatcacaatctagtagtaatagaataattggtagataaacaagttttattacatttttccccaaattatttaaaatagtaaaccatagcatattaatcaaaggtagttttgtattatttgtgataattttgagtaaaatagaaatgatgacataattacctatttggctggttttattcatagggagcatcaggtacatgtgcatcacacatctttggttcctctttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatctagtatactttgtcttttgtgatgattcagttttctctttttatagcctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaaggtatgttttgtttgtcctttttttttttttttttttttttttttggcatggttgggagataggggacttaattattttgtgggttttttcttttttaggtcttaggaaggtctttgttccataggtatctgtataatacaattttattaggtgtaatagagacagttttgtggaaacagaatgctgacactgattaaaattaaggtgtatatatgtttagtctttgagatgatctgtatgctacatgtaggtgtacattgtaattttctggcttgtaattttttgtatcatactctgtttcgggaatttgcaaatgcctatgaccagcctatgacatctgaaccataccaactgaccttagaaacagcgacctagtcttatatggtaattcctaaatgttagttaacagaaggattatgtctgaaccaaactaacaaggacccaaatatattttttaatcaacatttttctgataaattttgacagctggatgttttatagatggattttattgaaagttctgcctgataaaaatgaatttaaggcctggctcagtggctcacacctgtaatcccagcacttggggaggccaaggcgggcggatcacgaggtcaggagatcgaaaccatcctagctaacagggcgaaaccccatcactactaaaaatacaaaaaattagccgggcatggcggtgtgctgcttgggaggctgaggcaggagaatcgcttggacccaggaggtggaggttgcagtgagccacgattccaccactgcactccagcctgggtgagagtgaactctgtctttaaaaaaaaaaaagaatttaggatttctattttcaaggtgctaagactacacagttttagaagtctatgatagtaatcagtttatcagtatatataattgcatgtaaaagaaagtttctggatgattgcctaaaaaagcaaacccatggtgtctaagtgctatgaatacaagtacttttgtatgtgatttatctttctgtttgttttgagacagagtctcaccctgtcgcccaggatggagtgcagtggtgcagtctagactcactgcaacttctgcctcccgagttcaaatgattctcctgccccaccttcccaagtagctgggattacaggcgcccaccaccatgcccaactaatctttgtatttttagtagataaggggtttcaccaagttggccaggatggtctcgaactcctgaccttgtcatccacctgcctcggcctcccaaagtgctgagattacaggtgttagccaccgtgcctggccatgatttatcttataggggaaacttactgtctgtttacttaatttgcagcattctaaaaaaacatgtcttagattggttaatgctgtttatgaaacacaacatgctgatctttaaaaagttatgttctaccccgaagtgatttgagcgacttatattgatcatacaagtcattttgtattttcagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacaggtgataattaactttgatatttaaatgtttacatatctgtaaagtaacagcagttgaactgtgcgatcttcgtgcttaactctgttttgggaattattttttcttttagtttatgtttatctctcctctcttctctgatggagtctcactctgttgcccaggctggagtgcagtggcgcaatcttggctcactacaacctccacctccctagtagctgggattacaggcatctgccaccacacccggctaatttttgtatttttagtagagatggggtttctccatattgatcaggctggttttgaactcctgacctcaggtgatccacccaccttggcctcccagagtgctgggattacacgtgtgaaccactgcacccagcctagtttcattatttttagagtttgttctgtgttgttggaatttatggaagcctcatttttaatgaataacttaattcaattaagtaaatcttcccatggttaacttgcttatttagcaaactttttctttggattctttgttgcaagatttgaatagtcctttactttttggaagactaaatggactctcttctgactctacgatagatattctttaccagcttggaacaactcaggatcctggtacaaaagacaggtacgattttatttttcatttaattaagcacacacatgcacataatcatgctatagtaaatgtttctgacagtttttccttagatgatctcataaaagacaatactgtgatatattgtatgtttaccatatgcctcacacgatgtaacttctgcaagtattcatgaacattagacatacatttgtatgtgtttggacatactttaagcaaatttgaacttaaatagaattctttgttaatactgcttttgaggaatggaataaaacatatatttttaagttggctacgtgtgaaaggaaccttgtaaagtgatggtatcagagtcatactgtcttaggtagtactttatatgtgtatatgaatgtagggatattgtgtctgtagttggtacttcaactgtttttataatggttctgtttatttattattgattatcgtattcatcgaaatcttttcatgactttctgcaccctttcctgctgtttacagaatgaaacaatatcataacatgtaaatgacatttgaacacattggctaaatatttagtgatttttttcttttcttttctttttttttttttttttttttttttttacatttaggtaattttaatgagttgtcctaatgtcattctaccttgatgtcttctacttccaaattgataccaacttgaatttttgtttgttttgttttgagatggagtcttgctctgttgcccaggctggagcgcagtggtgcaatcttggctcactgcaagctccaccttctgggttcatgccattcttctgcctcagcctcctgagtagctgggtctacaggcgaccaccactataactgactaatttttttttttttttttttttttttttgtatttttagtagagacggggctttaccgtgttagtcaggatggtctcaatctcctgacctcatgatccgcccacctcaggcctcccaagtgctgggattacaggcatgagccaccgcacccggccaacttgaagtagttttgaaacatatttttgttgataaatttttgagcaaatatttggcattctctgtttttatgtgtagcatccatattagaaaaacagagagatttcttcctgatttatgttactttttaatattttgattaattatgtttaaaatgaagtcatttgatgttttattaatatctttataaattattaaaattatggattacatttaaacatagattgcaattgtttttgatgaagtgaataacaatttgtgccaaatttgaatcataatcgttagtagtggttaaaatatatttaaaatatcagtgttaaatatttttccagaacaggttgcttgaaatctgttaggattatttaatttttaaatattgttgtggctttttaataagaagaaaattaagcttaattcattttctctgcatagtactttttaaaacatgaatgtttgttatataaaactgacattaatgacaaggttgttagactgagaaaaatgtcttccttgtcttctgaattctctttattccccatcatgtgaaattgaaagtcttatctttcagaattagtattatataccttcctatccctgtttcttttagtgtgaagccaagaatcttatattctgaaatagaaattgaaggaaaataaacaaaatgtaaacacagtgttttaagaacttgagaaatctaaaagtctttcgctcccaggttgtggttcaaaattgggtgtgttttactggttcccaactccaggagattgggattagtggggttagttgacctataatcttgttattaatgttagttctaaatgacagatacctgtatttttaaaagtactatgcagagaaaataaattaagcttaatttccatcttataaaaattatacttaaaaaaaatatgtaagtgttgagagtgtattctgttgtcagaatgaatgagtgtgggtggctattactagtatttaatgctagggtccagggatgtgaaacgtgctgtatttcatgagactttgcacaatgaagaattagtcccagatcactgttctagtatgttatctcaaaccttttgatggttgaaattggtaaggttattggaaaattggaactggaactagtatgtctttgttgccgagagatttcctttttttcctattttagattaaaataatcaaaaacaattagtgcattattctcataaataccctactcaccatgcagagatggtatttatctatatgaaatgccaattgcactatatagttggttatatgaattcgttttcttcgtttaagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagtaagtatgatttgtgaaatcttttttatcccccagtactagatcagttagtgttcacttgataaaacaaaatattttacatgtttattaggagaaacataatattttgaaagtagcaaatataatcaagtatacttttgaaatgaattgtcaaatattaatttatctttgtgttttaagaagatatgttagcagtactgccttcttttttttaacctaaaattatgcttaatgtagatgttgctgtggttcatagtgtttattctcagttgcaaattttcccaccagattatctttaatgtacaactctggcaggatagtacagctagacaactttgggggtgggcatggtggctcacacctgtaatcccagcactttggaggccgaggtgggaagatcgcttgagtcaggagttcaagaccagcttgggcaacatgcaaaacgttgtctgtacaaaaatgcagaagtcagaaagctgggcacagtggctcatgcctgtaatcccagcactttgggaggccgaggtgggcagatcacgaggtcaggagttcgagaccagcctggccaacatggtgaaaccccgtctctactaaaaatagaaaaactagcccggcgtggtggcgcgtgtctgtaatcccagttacttgggaggctgaggcaggaggatcacttgaacctgggaggtggaggttgcagtgtgctaagattgcaccattgaactcaagcctgggcgacaagagcaagactctgtctcaaaaaaaaaaagtcagccggacacggtggtatgcacctgtcgttccagctacttgggaggctgaggcgcaagaattgtttgagtctgcagaagttcgccatgctgcctcacgccactgtaccccagcctgggcaacagagcgagactctgtctcaaaaaaaataactttggggagctgagatgggaggatcacttgaaacgaggcgtttaatgccagactggctaaaatagagagaccaaatctctacaaaaaaattaaaaattagccaggcatggtggcatgttcctctatccctaactacttgggacgctgaggtgggaggatcacttgaacccaggagttagagcccacactgacctatgatgatggcaccactggcactgcagccagggcaacagagcaagacgtcatctcaaaaaagaacaaaaatgtaaagctagaaaatttgagacttttctagattgtccttttgacaagtagtttttatttacccacatttcttcaccatatttagctaagtctttgctgaacttactgatagctaactattaagtctgcagcagaatacatttttgaagagttcctgtaacacataaaaagtaggcctattgttctctggtaggtcatcatatttggccttagcgattggcataatccatgacttaattactgagcctcactggtagttttttatttgcaaacatgaatttaagccatttgtcatgtggaatttaacgtaaacatttgtttggcatgatttttttgtttgtttgtttctctacatgaccttttcaggtcacacagaatgatagaaccattttaaaataatttacttgattttctgtactcattgacaagtctaactcaacttgcattgtacctacattcttcaattttaaatatatatatgtgtgtctatatatatatatatgcagtcttaaatcttacaatgttttattattcaatgtcaaataaagtatataatgtcagagtatactttgaactataacagaaatatttgaaatagtttcttctaaaaatatacttgtatcattaatatgatatcttttattttttaggttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggtaagacaaaaaaataacttacattttagttgttttattacataagaaagggccatgtataaaggccaggtaataataaatttagtgagggttgagtgcctttaaggatctgaatttaagctataaagtactgatatctcctttctccccctcaaaatatgctgtcactggaatcacttattctttatgatgagatgactagcagatgcattgggatgctagctagatcatacaacccttattttcaaaaatttctacaaacaaaaagaaaaagcccaaaaaaacatttcagctgctggaacagtatggacactgatcactgagtactgtatgtgccttgaggcattgtgtttttgtgtaacgagattgccatactgatagtttgcttctctttacatgggcattagattaggtttcagataggagactccacataaatcacatacaaaatgtggaagataggctggttgtggtggctcatgcctgtaatcccagcactttgggaggctgaggcgggcagattgcctgaggtcaggagttcaagaccagtctggccaacatggtgaaaccccatctctcctaaaaatacaaaaaaattagccgagtgtggtggcatgtgcctggaatcccagctactcgggaggctgaggcaggggaattgcttgaatcagagaggtggaggttgcagtgagctgaaatcttactactgcactccagcctgggcgacaaagcgagactctgtctcaaaaaaaaaaaaaaaaaatgtggaagataatttatcatactgcactccagtctgggtgacagagtgagactccatctcaaaaaaaaaaaaagtggaagataatttatcatatattatgattatcataataagctgggtgtggtggattgtcatatattatgataatcataatttattatttatcataataaattaaatcctgaaaggtagaattatttcaagagtaattctagttggctttttgccaaattttgcttttggttacctcacgtgaccttgggcatattggttaatcttataacatggggctagcaatacctgcctcaaggattttttgagacagttaaatattttaatttgtgtaacatacctagcatagagcctatatgagatatggtagacactagtaaataacttttctccttgttatttaatagtgctcattcaagtcaaactttagtagtacctagaaaaatagataatataatttttataaaatattgaaggagttagttttattaagaagaagggcaggtcgggtgctgtggcttatacctataatcccagctctttgggaagccaaggcgggtggaacacttgagcttagaagtttgaggccagttttgacaacatggcaaaacctcctgtctaccaaaaaaagaaatcataaccaaaattagccgggcatggtgatacgtgcctttggtctcagctactcaggaggcttgaggtgggaggatcacttgagcctaggaggttgaggctgtagtgagctgagatcacaccactgccctccatcctgggcgacagagcgagaccctgtctcaacaaaaacctaaacaaaacagaggaagaagagaaagatatttaactgcctgtagtaattaattactgggaaaatatctctgctaaatatgcattaaaaggaaatgcttaaattaccaacttcacccgagggcatgattctaggtatttgaaaatttggtttgtgcttctgggtagcatgaactctttgtgtcccattgatttctctcttggtttcttagtaaggctttatatacattttgggggtgaggtggggcaggatctctctctgttgcccaggcctgtagtgcagttgcacaatcagtgagccgtggctcactgaaactttcgggctcaagaagtcctgcctcagcctcccaagtagctgggactactggcacatgccaccatgcccagcttatttttttttggttgggggagtgggtagagacaggtttcaccacgttgcctaggctggtctggaattcctgggctcaaatgatctcttctcttagtttcccaaagttctgagattatcagcatgaccttggccttgttatatatttttaatatgctttttctcataatttttattttaagataaccacaccaatattgactaaagttaacgggagttcgttatgctaggtattcattatgtgcaaaccgtttagtactaattttttctaaccctggacacgtttcttacacttttatctcctttggtattcatatattttaagataaaatcatttctttcctccttaaaaaaaaaaaacttaactactagacccccagagacatttgttctttagctactgatttgatatgttaaaataaacttattcatattttctgtttcctttttatctttcaaaataaaaagctgcatataaatcttgcatttaactttttaaatattttgtcttgccaggttctttgtgaactatttcagacatctcctcaaagagggaaccttccaacatctgggaacatttcagggtttatacgaagattatttttacagttgatgctggaagatgagaaagtgacaatgtttcttcagtctccatgtccagtgagtatttaacacttaatcattggctgtgtatacatgtattttacaattttgtatcagagcctgcagttacctcctatgttctaacttcgagtatagcaaagtgaaactagcacagcctttatacctaatgacagaacttgacaatttcaggatagcgctctccctcatgcctaggaataacataattttaccttagcctgagaagtatagtttgatttgtggaaaaaaatgaaaaaaggtacagagtgataatgcaaaagttgaccaacaaatcatggcaactatgccatatctaaattaattatatcttgtaggatttattgagtattttattcttagatgcttttgagattattttataacaatatgtattccaaaaagttacttcctgatttctttgatttcttgattttcagctgtacaaaggtagaattaatgctactagccacgtcatccagcatccaatgtatggagcaggccacaaattccgtactcttcatttgccagtctcaacaacattatcagatgttcttgacagagtgtcaggcaagtcagatttaagtattagtttttgtttaactttatgtttgatgtatatggaggtttattgtttttataactttattttctgcatccactttgcaaccattgatgactaggaaagttcaagacatctttatagtttgaagcataagaagccagtcaagtggacaaaatgtaaaatacttttaggcacccctaattttttggtttattgtgtcacagtgagaaatgggcagctagaaatacagacaaataattgatggcatgttctcacaataaaccatctggtcattttatactagattaattgcaggatatttggttgaatagcaagattctaattaatacacatttactaaattgaaggtggtgatcagtgatcaagacataaatggagtaggtagaattgactggtcacctcattgtttatcgtagtcagtgaagaaagcagacagaacattttcccctaggttcttgcctgtattttataggatgatacctttaaacaacatatgggatagttttttaaaaagcagtttttgatggcaaaggcatatcaactttttattttatttatttatttaattttgagaggggggtctcactctgtcacccaggctgaagtgcagtggaacgatcttggctcaccacaacctgtgcctcccatgttcaagcaattctcctgcctcagcctcctgagtagctggcattacaggcatgtgccaccatgcccagctaattttttcatttgtttagtagagactgattttcaccatgttggccaggctggtctcgaactcctgacctcaagtgatccgcccacctcggcctcccaaattgctgggattacaggtgtgagctaccgcgcctggcccatatcaactttagatagttggagtgtattgccactgtgaaattctggttaatcagtgagtgaacttgctgagcatctgcaaagtgcaatcactataatttgtcctaagattataaacatgagcaagacacacattccacctcacaagatagttgtgatcttatgtctgttgtcaacttctaaaataaactagaaatgtctgtttgcattataacatgaatataagtagatatatttctatctgtatacataagaagggacctaagtttttaatggaagctgtgaactgaagcaagaataggagtatctaagaaaaaagttggaaatgtctatcagttaaaaatacaaatctaaagcccagagtaaaagagagagttaaagagatttgggagttgttaccacacatagatggtaagtgaaaccatgtgaatggatataatcattataggtaggaaagattgttttctgcttcacaatcgctgtgtctaatatgcatgtgcataaaatcgtaattctttcctaccgttttacaacttatacaataggttgttagcatactgttataaatattaaaaaaaatttatttgaaaatgactgccttatctgttacagagaaacttttttgaaaatttgatgttagacagtattttctatcagtttcctgaaattgtccattctacatgatgaagaaaaatgaaaattaaaaagtaaataaatgggccaggcttgttggctcacacctgtaatcccagcactttgcgaggccaaggcaggtggatcacctcaggtcaggagtttcagaccagccctgccaagatggggaaacacatgtctactaaaaatacaaaaattagttgggtatgatagcgtgcacctgtagtcccacctatctgggggactgaggtaggaaaatcacttgaaccctagaggtggaggttacggtgagccgagattgcgccactgcactccagcctggacgacagagcgagactctctcaaaacacatacaaacaaaattaaataaatgaagaaagtggggaggagcactgaagctcagttattgatattgatatttcatatgtttaacttgaagtgcaaaagtagacattctaatacaaaataactgaaaattgaacattttaattagtctttactgtggaagaatgctattctaaaacattctagcattcaaaatattttacaaaatagttttctgtattgcataaaaataaaagctaatcgctttggaagtacacgacctcaaaagttatatgtgctgaatgtaacctacttagcgattttttttggttctttaaagtggatttatactctttagccatattttctgatatatttacttgtacgtttatattagatcaacatgtataagaataagtaattcagaagtattgcctcagtaaatttacctgctatctgtagcttttgacagtatactttctttttttttgtttgagatggagtctttctctgcattacttgagcccatgagttccagaccacctgggcaacatagcaagacctcatctcaaaaaaaaaaaaaaaaaaaaaaaaaaaagcaaagacaacaagagaatattaaaactggccaaaaaggaagtgacctattattttttctctctctctgttttttttgttttttgttttttgttttgagacggagtctcactctgtcccccaggctgtgcagtggcgcgatctcggctcactgcaacctctgcctcccaggttcaagcaattctcctgcctcagtctgcagagtagctgggattataggcacgcgccaccacactcggctaatttttgtattttttttttttttttagtagagatggggttttgtcatattggccatgctgatgtcgaactcctgacctcaagtgatctgccttcctcggcctcccaaagtgctgagataacaggcatgagccaccacatcaggccgacaatattactttcaaataataacctttatgtgtcagtctgtttgcttttacaaatttctgtcactggttttaagcagtatgatgattgtgtgccttacaattttttcttcacatttcttatgattagagtttgtcgagtttcttgaatctgtgtgttttagatttcactaaatttcgaaatattttggcaattatttcttcaataattgcctcccctttttttataattacagttacttattaggctgtatgaagttgtttgacaccccaaatctgtgtttcctcttttcccccccatcattttttttctctatttttaaattttggataatttcctgtgtctgatctgttagacgttttatatctccttgtccttacttaaagtgtataggttttcttcagctttcttgaacatagtagtctgtttgtactatttttctcttccttatggattgtatgttctcgcttctttatttgcctggagaattttcttggatgccagacaatgtaaattttactttttggggtgctgaatattttgtattctaatatatatattttattttttcatgaaatataatgatattatttgaaaacagtttgttgcttttagacttgcttttaatctttgtaagtaggatcagagcagcttttaatctaaggcaagacttactgtaattattggtaatttttataaaccaatgttgtctagtttggtaactgttaagcacatgaaatgagactaagaaactaaatttttagattgaatttttaattttaatgaattttacctttaaatatgtacctcattagaatagaattaaggtaccaggtttgaaaatgcagttctaaatcccatttgaccccactattaaggctctgtccttatgagtactctgttaggaattcactagatgtctaagagcacaaagcattttattccctgaaaccctggggttgcttgccctgctacttttcgatagtacctttcctggccttcagtggtttgctcacataggttcgtcagtacatgttgaagtcttgaagaccctgtatagatctctggagatccagggatctccagatctctagatgcaaatctgcatagatgcaaatattttcttcctggatttccggctcttacatcctcagtctagggtgacaactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagttaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattagaaaccagagcatttttaaaaggaagttgagaaatttttttttagtgtttgaatggcatttattctttatatttacttttgaaataagggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcaccatgcatttgttatgtgtataaaattttttacttcacaaaactgtctataggcaattagcaattagtattaagaagttgtataaattgaaatcactttcatatactaaaaactgtaaaatgagagttattacaaaagatgttgtttattgttttattgtctcaacctttttaacataaaagaccgggtcataattgtgctaaattagggaagtaaaaagagaattgagctagatgcagtggctcatgcctggaatcctagcactttagtaggctgaggcaggcagatggcttgagcccaggattttgacaacagtctgcacaacatggcgaaacctcgtctctcctaaaaatacagaaattcatggcatgtgcctgtggtctcagttacttgtgaggctgaggtgagatgatcacttgagcctgggatgttgaggctgcagtgaaccgcgattacaccactgcactccagcctgggcaacacagcgagaccttatcttaaaaaaaaaaaaaagagaattggagacttgataacagttatatagtgaaaaaaattaaaatttcaaatcaattcattcagcctttaaatttcttaataactaaatcacattatatgatcacccatttattttataatttttagtggtgtgctgtatgccacagtaatgaaaggaatattcagagtaataactatctatgagagcccttaatactcattttttaaagtaaaacacattaaattttaaaacatattactttgttgtctaagattcctgtttttgtcctaaataaaaattaacagaacaggaaatctgttacagaaatttgttcttttatactttcatttgtaatataagcagaagtctagtttaatgctatagactgaatcttgagcttgagtcccatatttgccatatacagattatatcagtagcctttctaaggctgtttcttcattttgaaaataacattcatttctatgttgcgaggactgaattagatgcagttgccaagcacattgaactatggctaaaataaagcaagttttcatgctactggtttttcattgtttctggaggtggtaccattaaaatactgtatataatactttacagagattagatcttaaatattctggcttaagtacagtggtgagtcttcctcatcaatgtcagtaaagattgggtatcaggcctttacctcatgccatttctcctaaattcctttatattgccttagtattaaggataatattatcttgcataatctccctctgaaacatatattacttctcttcttaatgatttggaaaagcagtgtattttagataatatcttcttacagatactccaagtatcacagctaaattaattagtgaacaaaaagatgacaaagaaaagaaaaaccatgaagagaaagaaaaagttaaagcggaaaatggatttcaagacaattacagtgttgttgttgcctctggtatgctttctattttttataatcttgattttgtttgggtttctataaaatattagaattttagttacaggaaatttatgtaatacattgtactaatataaaaagctgactcgtaatgatgttttaatactagatttttatctttttatttttattttttttcactttccactaaataggttgtcatctgtatttcagagattatagcagctagctacagtttttactttttaggaaaatagttacagatgcaatgccaaaattatttatttgttgtcatgaaggacgaatagaattgggagattagatattggattagaaggaacatttctgttttctgacattagctaggaatgcatgccttattaaaatattttaggaacactgttttccttcatattagtgtgttgactatgtagaatcttactgatccttttcttttagggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggtaatattcctcaatgaataaacgtcaaagaaattttagtagccttaaaactatgtaaatcagaggcacagtcaccaaaatcattttaatcaggtgccattgatgagatcagtgagttagtgagacttcttccatacagttcctccgaagagaagtgagagcaaaggaggagtaatctattacgtatcctttttaacactatcaagttatttatttctactttactggttttctaagtttttctgtcagtgtgccatgaaatgattgatgaaatagacatttagagagttcatgacaagttatttaggaaacaccgtggggcaaatttgtaggactagttcaagcagtagaactcttagaccactggtagttaagccatatgttcttcccagataaaacacatttattgagcaccatcctgtctgttgttcaaggtgataacaggttgagcatccctaatccaaaaattcagtatctgatactttttgagtgctggcatgacacaagtggaaaattccacatccgacctcatatgacggttacagtctaaacacaggcacacaacacagttttttcagtgtccacaagaggaaaaagatcttccagcccccttcagatattttttgagcatgcccgattcctccctacatatccacagtgggtaacaaaactgcaaatgtgcatgccagacgtgccaacagcaggtttcccacgatgccccacatgatgccaagatgtgtgtgcattactgtgtttttttgctctgtggtgttggaaatttaaaaaaggccccagatacccttatgggtaacaatgataaaaagaggaagtatttatgtttatctgtagcacagaaaaacaagctgttggagaaactggacagcaatgtaagtgtgaaatgtctttcaagagagtatggtgttggagtgaccaccatacatgacctgaacaaacagaaagataaaccattgatgttctgtgctgcaagtggtgaatagaggttaatgaaaaatagaaaaagcactccatgaagctaaaaatgaagatattgattgtgtattgaaacagtgaatccatcagtgttggcagtgaacacgtgcctcttaatggtatgctgatcatgaaacaagtaacgatctatcatgatgaactgaatgttgaaaggagctgtgaatattcaacacactggttgcagaagtttaagagaagatacgacattacatttttaaagatttgtggtgataaagcatctgatgatcaggaagcaatggagaagttcattgataaatttgccaaagtcatggctgatgaaaatctgccagaacagtttataatgctgatgaaatatatccctgttctggtgttattgtctcaaaaagacactgggctacagttgatgggacagcccctccaggaattaaggataccaaggacagaataactgtcctgggatgtgctaatgcaactggcatacataagtacaaacatgctctgataggcaaaacctttcacacttgttgttttcaaggagtgaatttcttaccagtccatggttactctgacacaaaagtatggatcaccacagacatcttttctgattggtttcataaacactttgtaccagtggcttgtatgtactgcccataagctagactggatgatgtaggagtttgttattccttgatatcacccaattcatcctccagctaaaattctcaaaactaatgtttatgccatgtactttccctcagatgtgacttcattaattcagccatgtgaccagggtatctttagatcaatgaacagaaaatataaatccactttcttgaacagcatgctggcagcagtgaacagaggcatgggtgcagaaaattttcaaaaggagtttagtataaagaatgccatatatgttgttgccaatacttggaacacagtgacaaagacacagttgtgcatgtctggcacaacctctggcctgcaactgtgtttagtgataatgatgaactgtgtgtgtgtgactttgaaggattctgtatgtcaagtgaaaaaaaatgatgtctgacctccttacatatgtaaaaaatataccttcagagttcagcagtaagctggaagaagtagatgtcaaagaagttttgaactttgataataatgcttcagttattcattcattgactggtggtaaaatagtcgaaatggttttgaatcagggttatgatagtgatgaagaaggtcaagataacaccacagaaaaggtgcttatagaagaagacatggtgaaaatgtatggtgggcatattgaaggattacggcagcgtgcattaacaacagaatgaaaaaccatgtcagtttttaaaattgaagagagacttctgagctaaaaaccatgttaatgaggcagatgactccacaagaaccatttttaaaagccttccagcagaatgtctcttcatcccccgtaggatccacttcctggtccctcagctgcttctgatgtttcttcttaactaaaaaacacagtttatagtaacctttgaataaaaacacagcatcataggtgaagactgaaagcctgctgttgtttgtagctgctttttcctttttttttttttgagacgtagtttcactcttgttgcccaggctggagtgcaatggcgtgatctcggctcactgcaacctccgcctcctgggttcaagcagttctcctgcctcagcctcccgagtagctgggattacaggcgaccaccaccacgcctggctaatttttgtatatttgatagagacggggtttcaccatgttgaccaggctggtcttgatcttctggccttaggtgatccacttgccttggcctcccaaagtgctgggattgcaggcatgagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaaaaaaaaagaaatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccaggttaaagtatttattagctgtccttttatagaaaaaaatgtcccacatcagatttatggaaatgtctgttcctttgtttacgttttgcccatgactttttaacactttcacagacattattgttcattattatatgtcagaaataaactcactttttgtaaactttccaatggctgttgaattttttaattgttttgaaattggtttcagaatcaaactcttgcctgtaatttagtaaaagcagataataattaaaccaagtaaatgtttctttctcggtttccagatttaacttagttatatcattttaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaaggtatgtgcataatactactttaaaaattacagactgtcatacaaagaggcagagatttctatagctaatgacttaattgacttgtgtttttattatatcaacataagatataatttttttatgactgaatttttgtaaatataaaaaatggccattatttcatttggaaactaagttgcattatttcttataacatcatttgttttatgagcgcatgtactttaatttctgatatttctgtgagagctatgtgaattgtcattttataataaaagtgagaaactcaacttacaactttgttataatttatattgagtggcatttcttgcatataaacatgttttctcatataattgggatcacatatttttgttttttacttatatattccattaattttttttgagacagagtctttttctgtctcccaggtcggagtgcagaggcacgatcttagttcactgcaacctccgcctcccgagttcaagtgattttcctgcctcagcctcccgagaagctgggattactggcacccaccaccatgcctggctaatttttgtattttttgtagagagaaggtttcaccatgttggccaagctactctgtaactcctgacctcaacttatctgcccgcttcggcctcacaaagtgctgggatataggcatgagccaccgcacccggcccttatattccattaaatatttttgaatatccatttttgaattggctattttttcataaaaatgtaagaaaatttatttgttccccaatcatcgaaacattgtggttgtttccaatttttactcctataaatgctatataagtagttttcatagtgtgagtatgatatgaacttacttaaactttccatctttctcatgactaaaattcagtctttagttattggtcttttgtattcttcagcaaattttggtacattgtctttgcccagtttttcagcacgattatttctctcttttgttttaatgtttaaagggtctggttacgtgaccttttggttttctttggtgagtaattcagagttaaactaatatggtataattttttgttttaagtaagggaagtctttgtcattaatttttcttaataggatactttagagcatattatttgctatgagaactttgagaacttatttattttaacataggatatacgttaaagtatgccctaaaggacagtgcttctcaaacttcagtatgcttacaaatgaccagcatcatactgttaaaatggagattcttcatttcaaactagcttgcaggtgatgccaatactactagtccatgaaccattcttccaataacaagactaaagaaggcagtatcagaagtcatttaaaggtcattgtaccgtctagccataatacagctatatctaaataaatgatgttttgtgctcttttttgagtagcaagaaagcagtaatacctgcttttgtaaatgaaagaatattataaaaatataccctttcttacctattcagttatttgtaatttattgtctagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtaagataagatttcctaatcgagtatatcattccatagctaagcccttcattctttttaatgtttgttttttaatgtacttggattaactttgtagaaataccctttgctttatattttttgaacattatataactctttcaatggtcagtctgtacagagcttcatgaccttcagtaggtatggaagaaatgttgaagatcaagcacacttgccagacttactacactgttgcatttatcttgatttcatggttgtaacactagcattctcttttctatgctgctttaagtgtgatatttattagagatattattggaaataggagaagtaaaatagcagtgtatactgccaccaatatatgtctttttgtttaccttttattcctgtttcaggtgccatttccatttttggtggtttaaaaacatgacctattcccgtgttcatttacgaagctgtcaatgtctgtgctttccatgctcttgtatcaatcagtaggaagtatggtgcatggagagttgtaaaaacaaaactttgtgtttgttgaatgaagtaggggaattattctctttgatttcatgtcgtgtgtgtgtgtgtgtgtgtgtgtgtgtgtgtgtgtggttattttggtatagtagctctagactctattatagtttcctgagctgctgtaccaaaataccacaaacgggctggcttaaaacaactgaaatttattctcaatagttgaggaggctgtaagtctgaaatcaagatatcagcagggccatgctccctctgaattcaggctgtagggaagactccttccttgcttcttcctggcttctattggttgccagtagttcttgctgttcattggtttgtagctgaatcactttaatttctgcctacgtcgtcatatggccatctttcctgtgtgtccttgtatctctttctccttataaggacaccagtcatttaatgtagggtcctgcaaaccattatctcctcatcttaacttgattacatctgcaaaggccccatttccaaataaggtcatcttcataggtgctaggggttaggacttgaacatatcttgggaggacaaaatgcaacacacaataatacttattcatgttattgcttccctagtattcaaaaatataagatgatataactatgttataaggtgattgacacagaatgagcaaaattttcttactagacaatgacataattactcaaaagtttgaagcagaaaagaccccaacattttcagcattattattgctcaacataaatgattttttctaatttagtattcagtgtggttcactatattgattagtaactggaaatggggtcctggtaatacatacctaagaatgtgaaagtgactttagaattgggtacttggcagagtatggaataattttgagtagcatgatttaaaaaaaaaatctagattaccttgaatagattgttagataaaatgtggatgataaagcttctgccagtgagggcccagaaggaagtaaggatcataggggagaaaacctacagtgtcttagagaatatctgaattgtcataagcagacttggtagacatacaggtgtttaaagtgctgacaaggtggtttagaaggaaatgaggaacatgttaccggaacctgaaggaaaagggatctttgtcatatagaagcagaactattaactcatttgtgtcctaaatatagaaagcagcacttctgctgtaatgaacttggatgtaatgaacttacatgtaatgaacatgtaatgaacttggatgtttagctgagatttccacacaaagtggtgaaagtacaacctgtctttttcttgctgcttatagtgaaatgtgcgaggaaagatataaattgagagaagaactgttgaaaaacaagcaatcagtgcttgtcaatttgtgaaattacctatccagatcacagaaggtgctaaaatttagatatttgctatcagaaaagcatgctccaaagtataagccaagagtgaggctggacaaccttttgctagtgccttagaaacatcaaaagtcagagtattcagtcacatagagggctctttgaagagattaggcatgtaactcatggatctcctcagccgtctaagcataagcgaggaatagaggatatgatgtgatgatggaagcatccaagagccatggaacgtaagttgcctctggaagctggaaaaggtgaggaactgttatttcctaagagcctccagaagcaatgcatcctttgattttagtcccataagacctgttttggatttctgacctctggaattttaaaataataaattgtgctgttctgagccactgagtttgtggcaatgtgttatagcagcagtagaaaactaatacagagtttggtctgtagttgtaatgcctttgtctggttttggtgtcaggatactactagctatatgggatgggttgagaatttctaatatatcaaattaaggatactgttaggtgtgtttaataagagacactgtctgggcatggtgtaatcctagcctgtaatcctgtaatcacacttgtaatcccagcactttgggaggccaaggcaggagggtcacctgaggtcagcagttcgagatcagcctggccaacatggtgaaaccccgtctctactaaaaatacaaaaattagcccggtgtggtagtgggtgcctgttatcccagccgttcaggaggctgaggcaagagaattgcttgaacccgggaggtggaggttgcagtgagccgagatggcttcattgcactcaagcttgggtgacaagagtgaaattccatctcaaaaaaaaaaaaaaaaagagacactgcagattgcaacagtagtgaactggaagatgtatcaaaagaaatcattcggcttggcgcggcagctaatgcctgtaatcccagcactttgggaggccgaggcaggcggatcacctgaggtcaggagtttgagatcagcctggccaacatggtgaaaccccatctctactaaaagtacaaaaattagctgggcgtggtggtggacgcttgtaatcccagctactcgggaggctgaggaaggagaattgcttgaacccaggaggcagaggctgcagttaaccaagatcgcaccactgcactccagcctgggtgacagagcaagactctgtctcaaaaaaaaaaaaaaaaaaaaaaaaaaaaatggttcaaatggaagcatagaaagtgtaaggaatgagaagaacataagagctgtatggactgaagtgaaaaattctaacttacatgaatttatagtccgagaagaagagtgagttgaaacatggacagaaacagtattgagaagaagaaaaatttcccaaatagatgtaaaacttaaatctcaattcaacatgtaagaaactgttaactcatgcaggatatgcatgcctggaactgtcatggtaaaagtggttaaaaacaaagacagctggccactgcagtgcatctctgaaatcccagctactcaggagactgaagcgggaggattacttgagcccacgggttccagaccacctgggcaacataacaagacctcatacccccaaaaaagcaaaaaaaaaaaaaaaaaaaaaaaaaagctaagacaatgagagaatataaaaaccagctataaagaaaatgacctatattttcaaaacagcagcaataacactaacaactggcctttcaacagaaaccatatgagccagggaattacaactttattttattttattttttaaattatacttttagggtacatgtgcacaacgtgcaggtttgttacacatgtatacatgtgcaatgttggtatgctgcacccattaactcatcatttaacattaggtatgtctcctaatgctatccgtctcccctcctcccaccccacaacaggccccggtgtgtgatgttccccttccctgtgtccatgtgttctcattgttcaattcccacctatgagtgagaacatgcagtgtttggttttttcgtccttgcgatagtttgctgagaaagatggtttccagcttcatccatgtccctacaaaggacatgaactcatcattttttatggctgcatagtattccatggtgtatatgtcccacattttcttaatccagtctatcactgttggacatttggcttggttccaagtctttgctattgtgaatagtgctgcaataaacatacgtgtgcatgtgtctttatagcagcatgatttataatcctttgggtatatacccagtaatgggatggctgggtcgaatggtatttctagttctagatccctgaggaattgctacactgacttccacaatggttgaactagtttacagtcccaccaacggtgtaaaagtgttcctatttctccacatcctctccagcacctgttgtttcctgactttttaatgttcggcattctaagtggtgtgagatggtatctcattgtggttttgatttgcatttctctgatggccagtgatgatgagcattttttcatgtgtcttttggctgcataaatgtcttcttttgagaagcatttgttcatatccttcgcccactttttgatggggttgtttgtttttttcttgtaaatttgtttgagttcattgtagagtctggatattagccctttgtcagatgagtagattgcaaaaattttgtcctattctgtatgttgcctgttcactctgatggtagtttgttttgctgtgcagaagctctttagcttaattagatcccatttgtcaattttggcttttgttgccattgcttttggtgttttagacatgacgtccttgcccatgcctatgtcctgaatggtattgcctaggttttcttctagggtttttatggttttaggtctaacatttaagtctttgatgcatcttgaattaatttttgtataaggtgtaaagaaggcatccagtttcagctttctacatatggctagccagtttcccagcaccatttattaaatagggaatcctttccccatttcttgtttttctcaggtttgtcaaagatcagatggttgtagatatgtggcattatttctgagggctctgttctgttccattggtctgtatgtctgttttggtaccagtaccatgctgttttggttactgtagccttgtagtatagtttgaagtcaggtagcgtgatgtctccagctttgttcttttgacttaggattgacttggcaatgcgggctcttttttggttccatatgagcttgatggggatgacattgaatctataaattaccttgggtagtatagccattttcatgatattcattcttcctacccatgagcatggaatgttcttccatttgtttgtatcctcttttatttcatcgagcagtgatttgtagttctccttgaaggggtccttcacatcccttgtaagttggactcctaggtattttattctctttgaagcaattgtgaatgggagttcactcatgatttggctctctgtttgtctgttactggtgtataagaatgcgtgtgatttttacacattgattttgtatcctgagactgctgaagttgcctatcagcttaaggagattttgggctgagacgatggggttttctagatatacaatctgtaacaccccattgtcaacattagacagatcaacgagacagaaagttaacaaggatatccaggaattgaactcagctctgcaccaagtggacctaatagacatcaacagaatatacattcttttcaacaccacaccacacctattccaaaattgaccacatagttggaagtaaagcactcctcagcaaatgtaaaagaagagaaataataacaaactgtctctcagaccacagtgcaatcaaactagaactcaggattaagaaactcactacaatttcaaaatgctagaagacaacaagcaacaaaataagcaaaaaaatctgtcatcctagaattttatactcattggagaaaattttctacaattcttcacccacctcgcccatcgcctctcaaaaatcagtgatggcagaataaaaagtatgggattaactctgttgtctctatatagttaaaagctctaggcaaaatatattttaaaacaattatttaggccgggcgcagtggctcaagcctgcaatcccagcactttgggaggccgaggcgggcggatcacgaggtcaggagatcgagaccatcctggctaacgtggtgaaatcccgtctctactaaaaatacaaaaaattagccgggcggggtggcaggtgcctgtagtcccagctactctggaggctgaggcaggagaatggcctgaaccccagagggcggagcctgcagtgagccaagatcgcaccactgcactccagcctgggcgacagcgagactccgtctcaaaaaaaaaaaagcaaacaaaaaaaacaattatttaaaggctttaagagcaactagaagcaggcagaaattaaagaggattttaacacaatattaatagaatcaattcagtaatattagcgtctatactgcttttttctgggggtattcctcagtctttgtggggtgggacaggtagaactcagacttaagccacagtcatattggctggagtttgattcttccctactggctggaaaataggaattcagaaaggaggaagctgaagctgaggagctccaaattctgcacatccatagcttgctccagaattattaaacataggcattttgagagcaggcatgaactagaatgctgaaaaagctgtgcagagatttcagctgctgtctgtcaccgagaggatacaatttacagttttagtcctgctcagagataaaaatgttggcttttccattggaattccaaatggcccatacattaggaataaaggctacagcctaataaagattcacttgagaaataagggaaaaatcaaaatagactcttctaataaattacaaaagcctctaagttcagggtgatctcccaataatttacgtatctgctaaacaaaactaaacacactgcaaggaagattttcaaatcaagagttgatagaagatctcatcaacaatgtacagtgtatggctgggcatggtggctcatgccagtaatcccagcactttgggaggccgaggcaggcagatcacctgagctcaggagttcaagaccagcctggccaacatggtgaaaccctgcctctactaaaaaatatgataattagccagcagtggtagcacacctctgaaatcccagctacttgagaggctgaggcaggagaatcccttgaacctgagatcgtgcccctgcactgcagcctgggtgacagagtgagactccatctctatgattgaacaaatgaatgaatgaatgaatgaatgaatgaaagtgtattaaataccccatttgaaaagcaaacgtttgtcagaatagaggaaaaagcaaagcccaagtatatgctgcctaaaagagatgtgcttgaaagaaaaaagctgctacccctattttttaatgtatcacaaagttgaattatagaccacctgataagaaataaagaggatcattaaatcactatgaaagtattaattcagaataagtcataacaatcctaaatttgtgtgtatttaatagcttcaaagtacatgaatcagaaatttatagaactgaaggaagaattagataaatctacatttcagtaatagattataacatttatctctcagtaaatgaaacaaagtgaggaagtaggagttgttgggggaaacgcccaaaacttctagatggacgtaaccaatatttatggaacaaagcatttaccaactacaggatgtacttctttccaaagaaagatagacagtatgctggcctatacaaaaagtctcagtaaatttaaaaacattaaaatcaaacccagtatgttctgtgaccacatcagaattaaattggaaaccaatagcggtaagatctagaaaacctcaaatatgtgtaacctaagcagtatagtttttagtaacacatggatgaaagaagaaatcacaatagatactacaagatatttcaaaacgataatgccaacatgacatgggatatagctacagcagtctatagagagattttatagctttaaatgcatataattaaaagaggagatttatcagtggtgtacactgccacctcaagaaactagaaaaacaggagtacaattaaccaaaaatcagaagcaaggaattactacagtaagagccagaatcaattaaatataaaacaaaaaaatcaaagagaaacaagaaagtcgtacattttgtcttttgagacttctagtaaaattgataaactatgaaaaattttcaagaaaaagggaaaaccacacaaattggacatccacaaatgatagcaagcacattattataatttctatagaataaaataaggtactattataaccaactttatgccaacatatttgatacttagatataatggataaattccttgaaaaacacaaccagaatcagtagaagaagtgcatgtatacgtttgtatgtatacacttatgcagaattgtaatcaaacatacagaatttttagtctgttttcatttttaagtaccatggttatgattttgaaatcacattaatcccatgtttctccaatttaaactgaaactcattttttgttcttaaattggagcatttgactactttagaaagtatcatgtcttctcagtttgctgtgacatataatgagtatcagaattaaagacatcacatggttggaatatcgtaattcctaaaagcctgtgatataaatcatatcctgttcatctaatttaaaataatttatttgtgttttagacattattcaaagtgagcacgtccttattagagtcttttctttgggaaattgagctgttttatcctagtatatcagaaataaaatttctttgttgttaattgagcaaaaagcatgttttcatatacttttcagttttgactttcaaaatgtgaaataatacaagtgaatataatactttaaaaaattaaatccacttaatattaataccctaaaacagttctgtttgaatcgttatacttgtgacatttatgtaaatatcagtttatattctactgtttggtgcttttgctgaacctgtattttgaaattaatctttgttgatgcctaagcctgtggtggtctcatttgtatagctctagcatacttgctgtatatttaactataccttattgtgtgtattagtcttaatgttgactagcatttttatttccagttgttagctataatgaaaaaagttgtgaagaattgtatacatatctaatataagacttaaaaatttgtatctgtataatgggtgatgggaaatatatgatagtggttttaatttgctcttctgattttcgtgaagttgagggtctttcacttgttaaagaatttgaatgctataaattgagagctctttgattttgctgtctttttgctttcattgtatttgttttgttttgtggcatcatatgagaatagtcctttaagaaaacaattatgatgaggtaaagttctgcttctgtaacaatgttctattatataggtacttttatatgaaactatcttctgtgcagcataaaataataaatatagaggatctttaaaaatttgcctataaagggtttcaaaatggtttagaagtgaaaagtgcctcaaattcctatgttcttacaattaggctatttcatattgtcattctggcctaagcttcagtagtgaaaataagctggcatcaaaattgcacctgttttattcagtgtacagatgcatgtagtgtagccgtagatcaacttaagactgatctaagctgtagatcagcttaagacttctacatatatatgtaaaagaaggaagaaatagtgaactaatcacagagttacctcaccattcatttaaaaatcaccccacagagttacctatcagtctactaaagtcatacaggaagcttaggaatcatcctgatgtttgaagtgaatagtgagataactctgtgattagctcactattcatttaattatatgtttgagtgtggaacttcaaattagtatttagtgaagtgcattattcatggtcaagcaagataagtagagtatttctaaatgcaatgagaagtttgtagggcaaccatgctcagaattggagtttttctttgaattattaagattaaattatagacatgatgctcctttattcctaagttcagaaaacttctcttggataaccatatacagttatacaaatcagaagttcacactgactctgtactataaactgcaaatcttattcagcttttgcctgtccttctaatgttctttagggccaaagaaaaatcaattttcttttgcgtggtttgaggatactggtagttcaggatcatatattgcattttgttgtcttgtagtcttgcatatgtaacaattctgctatctttatttatctttcatggccttcatggccttgacagttttgaagaatacatgctagaaattatgtctatatatatatatatatttacacatgtatacatacatgtattttctaggtatgtttgctgataggacccagaagcagactccccctagtgatatatgcatatatatctcccatattgtcattttaaaaattttctactaaaggaaatcagggctccttggagaaattctagtactgaggaagagtaggtagaacatgagcctagaatgttttgctgtgctagaaagcaaggaagtgctcaaagaacgatgggggacaagttataaggaagtaggatcctgctttaatggcgtctcagagacaaaatcttattcccctcaggcatcaaaattaataatgatagtaacagtgtaataaagttagaatctatactgataaaaattaatggataagaagagaatatttttccttatagcttggtgccaactaataaatgtagaaagaatgacagaattagaaagttctccttttcttaaccactttagtaataattgtttcaggcacaattataaaaatgctaagactgatcaaaagtttggtgagaaataagatgtttaaatagtctcaagaatctgcatatagatacttaactaattataaaggtggaattaataactaatgtagagacacttggcagacactgccatacttctgctgtcatgtgcgtcttgatgtttggaagcttgtttttatttttatttatttttttgagatagttttgttgcccaggctggagtgcggtggtgtgatcttggctcactgtgccttccacctcctgggttcaagtgtttctcctgcctcagcctcctgagtagctgggactacaggtgtgcaccaccacacctggctaatttctgtatttttagtagagacggtgtttcaccgtgttggccaggctggtctcgagttcctgacctcaagtaatccacctgcctcagcctcccaaagtgctgggataacaggcgtgagccactgcgcccggctggaagcttgttttttaaagcaagcagctttattaatccttataatcctatattttaaagagatcatttaaagttaagtctttactttgaatctgatgttgaaaatgtgaatggccaagccaacacttttctttttctttaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtaagtgtttagtattaaatttatcaacacatatgtgaataggttgtgtaaaggtatccagatcattgcctattattcatcatttatttccttcatagttaagctgttagatgatttgtaagtggtagctcacttccagtattagttatacataataaatcctaaagaatcttcattttcatctctgtgttcattcaaaaattattttccttgtgctgacaaaactgttgggcatcactggggggatgtaaacatgaagcagttatttagagctacccccaagtagctaatgttctccagtaatagaaacaagggatgtacataaacatgtatacttagcaagttataaaatcccttcagtactcttgagtgcagtattatggagaaacacacatgtgagattatttctttactactcagcaatgtgaatgaagtggcatggtagtttttagtggggccttgaaggacagattagatttaggttgggatgagttatctcagaaaataaatggaaagagcagtgttttgaggttaaaatgtatgagaggggataagttagcagatgaaaatttgcacaaaagggagcattgtgagcattttaaaagctaatattggtaacagatcatggaaaaaacgtactaaaaactttagattttattttgaatagcaataaaggtttattaaaatgtgttaagattagtgatgtgttgaatatagtttttttcagaaaatgaatctggtagcaatacttagattaaagagaacagaattaggaaaatgatgccataatatgtattaatgataacatagaataataagagaaagctgtgatgattgtttccattgggttggcattgttatttaatagaaaaactgaagaattacaggatagcctcacaagtagattttcatttgggtgacgtctgcattttcttttttctttcttcttcttttttttttttgcattttcacttactatttattctattaatatttattagaaaattaatattccttatgttattttaaaatcacatggttttgattagggtcgatttctttcacatgccatttagaaagaataaaatgttaagttctgtactacaaagtatatttaatctaataaaactatatgaatttatgtgtagatctcaaaactctgaagctatcaaatattcaaagtaaatattttttcctttatattttcctaacaacaaaaatccctcataaatgttggcatataagtgggcccatgtagtttaaacctgtgttattcaggtgtcaactgtatttattttagtaggtcaggaatttctaattacttgatctgatttttttttaagtagatagaggggtaagaaccatattttttattgatacatagtagttgtacatatttatgttatacatacgatattttgataaagacatagaatgtgtaataagaaccatggtatttcaacactgttaccacagagtgttaaagtaggtgtaaccctaaacagaaaaggaaaaaaaaatggctttctgtaatttcacactatttttagtgcatatacaatgaatttttattaaaaaggatagttatgatatctctctctctaataattgtctcgtgtaccatccatgtagcattgctttctttgcatttaataccccttcctggctagaacacagtagaacactgttgggaaaaaaatagttttacttgttcattatctgttcttggttaaagctactcccaagaaaagcagttactttcttactgttgtaagatactactaatgcttcttttctattgttcaggttttagtttaaattctagttcgtaataattttgacataatctatagctatgatcatacatatgtttccatttttttgaggtttatgtataccgtgtctgacagagtttttcctgatacttattcgttattaaattttaagatattactgttgtatttgtggtatttggttttctaaataatttagtggtatacttttgtattacagtgtcattattaatttatgaccctgtatgtaacttcttatgtgtttttaactgtttttaatcttgagtcctcttctttcttcaatctaggtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgaggtaggttcacttttaattatttcagttattaaaaaaactagatttaattagggagtacagaataaagtttttttctgaattaatctttcagagacttgggtgttccattttcacatctaaaaggatatttaaaacagaaattgtaaattaattgttttctctattagtcttcttcagtaaaccaaaaagaaacctatctacttgaaaagcagaaaagatttaagcgcttaataagctttcccatttaccaagatacactgaatttatactgtgatccttcttcctttcctttttgaacttttaagaataatactatagaatgggggttgtgggtggggatctagccagtgcaataagacaggaaattcaagaaagaaagaaaaaaattcctcattatttcaatatgatttaattgtattgtagaacataccagaataggctaggtgaggtggctcatgcctgtaatcccagcactttgggaggttgaggtgggtggatagcctgaggtcaggagttcgagactagcctggctaacatgctgaaaccctgtctctactaaaaatgcaaaaatttgccggacatggtggcgtgtgcctgtaatcccagctactcgggaggctgaggcaagagaatcacttgaacccaggaggcggaagttgcagtgagccaagattgtgccattgcactccagactgggcgacaagagtgaaactgtgtctcaaaaagaaaaaaaaaaataccaaaataattaatggcataagtgagtttattaataatacatcatggggtcagtctataaaaattagttaatttctacatactagcaacagacataaaatgagctttataaagatatattttagaatagtaccaaaaatagaaaatatctaagagtaaatctgaaaaatatgtataatacctctttatgaaatttttgactgggcatggtagctcatgtttgtaatcccagcactttgggacatagaggcaggcagatcacttaaggtcagaatttcgacaccaccctggccagcatagtgaaactctatctctattaaaattacaaaaattagccgggcctggtggctcacacctatattcctagctacttgggaggctgaggcaggtgaatctgtctgtgctcatgtatatcttcagtgggttagatatgatagtgcaataatattatttcttcccagatcaatccttaagtttgatacaattccagattcattttggaggaagtttacaagccaattataaaatgtatataaacatgcaaagggtcaggaatagctgagatatccttttgctatatttatcctaaaaagatctgctcatatctgtattcttttcactgttttctcaattcaattttgagtcattgactttttaggctctaaggtggtttatcccttcttttcttgataaatatttgaaaatttgtatttatttatgtgtttattgattcattcattcttaaatataagcagtttctctccatttaccccttcccccagcccctggcaattaccagtctgcattctgtctccatgcatttacctattttggatattgcatataaattgaatcatgtaatgtgttgttccttgcgtctgtcttctttcatttagtataatgttttctaggtttattcgtgtagcgtatatcagtacttcatttcttcttatggctcaataaatatcctgtttgttgatccattcatcggttggcatctaggctattttcatcttttgttttaaatggtgctgctgtaaacgtgtgtgtctatttcagcaccagtttttatctgttttaatactagaagtagaattgctgggtcatacagaaaatctgtgttcaatttttttgagcagccaccaaactgttttccatagtagcttcatcattttactttcccagtgataaatatttttgaagataagcaaaaacaaattgtaatggattttcattttttgttattttaagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggtatatttgtaaacttgatattgttcatgataatggctttttttttgtatttattattttaaaatattgataactaatccaactttcctcagctatgtttatgcccacttgtggtccttcttcccagtgcattctaagataccactggataaagattgttcttgcttacttgtgactctgtatttcttccctctcaactagcttcttcactgagaggaaagtggcagggatgaaattatccagtagctggaagatgcatcttcctacaggcattttcttgtttaatgtgttgtatctggccttttttttttttttaagtgttatttatttatatgcattttggttgcttacttttttttttttttttttttttgagacggagctcactctgtggcccaggctggagtgcagtggcgtgatctcagctcactgcaaccttcacctcccaggttcacggttgcttacattttttaaaataacttttcagccgggcgtggtggctcatgcctgttatcccagcactttgagaggctgaggtgggtggatcacctgaggtcaggagtttgagaccagcctggcaaacatggtgaaacctgcctctactaataaatagaaagattagctgggcttggtggcacatgcctgtaatcccagctactcaggaggctgaggcaggagaatcacttaaacccgggaggcagaggtcgcagcgagccaagattgcaccattgcactccagcctgggcgataagagtgaaactcggtctcaaaaaaatgaatagataaataaataacttttctagattcaggcaagttggacaagaatagaaagtctttataccacagaaatgtataggggaaataatgaaaaggttagctttgcttcctgcatcagctaattgaagttcgtcagtgctttgaatgtgtcttctgcaactctagaatgctccttctagtataaagttctaagattttgttaccttcaaactgtgaattgagtctattcaataaaatatgtaaataatacagagttgctactacattttttatgttcgtagttgtattgcttttatatgtctagtcatatgtagtgtaccatcctttgtaagcaacactctcagacaaaacagatccttctcttttgaaaatttaaacaaataattattttaaaacatagtataagatactgattaagtagaaaatatgtactcttagtattcagattgaatttctaacctacaataaaaacttttgaagtatgtgaaactgaaatccaaattaatttcaacaatttttaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcaggtaaataatccctgtaaatgtgtctgtggatgaataattttgtttgcttattttatcattgtctaatagtaagtttcagttgaaatagttgatggatttatttcctaaaaagtattctggaaatatttagttggtttttggtgcccttaatttgatactttgtcatcacttaccatagaacacagaataataaaagtttcattattcctttgtctttatctgtgaaaggtgaaagtaaactttttttccttttaatcatctgtaactgaaaatgataggacaaaggctaacaacttcatgacatcattctgatctgaatatggtcaaatttctatggattttaaatatttttgtcaaacactatcgcagacaacagttatttttgaagaaaggcagatacatgaatcaagtccataggtacttgataagatgatgattaatttcttaaaattcaataataaaagtactgtagctacttgttttgccagtatacaactgattattgattgaataatatagtttattatttccttggttatggaattatctaagaaatgtgttcttttcctaagaatagaaagttacatgttcagaaatgtatagatatttccaagagaaacaagcagttaacatctatttctttcagccaaaacctttattatttattgtttcaactctgtttaactcatattcttatctctgtctttatcttcttatgaaaatttacatgtatatttcattaatttattaaggaagaatagataagggaaacaatggaaatgaatcttggtagtctattttgtggttggtagcagctaagtgacacagttggatgtctggtaaaaatattagtatttcaagggattattgcccgtattccccagtatcaggaagattgttgtcctttaaaaatacgctatttcccagtctgtctcagactccttcatggaagtattagattgatttttttgtttgtttagattgacctgtttgatacatcagactggtcttttttaaaaagtagatgtcaaatgcataatttttttttattaaaatgtttgagactatacattttaattttagattatatagaacaattgaatagggtgcgataggtttctttttatctcacttctctattattaaactattattttcttaatccttatactgtgaagatatgacctaccaaaaattttaaatttctgttttggtctgaaattgactctcttataacactgagcttttatctttatggttcattgtcaaaaaggaaatccaggattatttacataatatttacagtaattgttgttcatgtaagtgcacttcctgggaaggtgtgtatgttaaactgatttttggtaaatgtatggaattgcagagacttagatattataccttggaactgttttagaaatttaatgtgacagatcgaagtttgacctttcttttatgatgtattattttcctggaaaaaagaaatttctttcatcaggctttagatgttcttgaatttggtaacttgtccagtggttaattctaattgatatatttggatgtggtaacaaatacttattttgagataataccttatattaagataaaatgatgtaacttatagtcagtaggttaaacggtagcatgcctcctaaatgatattaaatatggattgttttcaggaaaacacagcttaatataagtatataagtacatatataattaagtaaacataaatataaatatataaatatataattagttatcagttttggttagaatagtaataattttttaagtggctactatttatttatttgagacagggtttccctctgtcacccatgctggaatgcagtggcacgatcttggcttactgcaacctccacctctcaggttcaagcaattctcctgcctcagcctcctgagtaggtgggattacagacatacagcagcatgcccggctaatttttgtatttttggtagagatggggtttcaccatgttagccaggctggtctcaaatcctggccccatgtgatctgcccaccttggcctccaaaagtgctggaattagagacctgagccaacacaccctgccttaagtggcatttaaaaacctgaacaaattatctagccagagtcttccttagacttagtaaaatttctattttggaaaattagtctaaagtttattttccaattttttcatttgcgtatatagtattatttttggcaatgtgggagttgaggtaatgtgataggatccactccaccattttttactacatttagttgtcatgtccttttcttctgtaatctggaagagttcctagcctatctttatctttcataatactgatatttttacagaatgtaaccatttattttatagaatattctacagattggtttgtaagtgtgagagtagtcctcataattttgcctgagacattgtattcaagggatgatttgcttatattgctagcagatgatataaaaaaacgcaggcctaacataatagccttttctgagaactttagtaaaataatgcacattttctttctataacatgtttttaaatgattggtgagcaagacaagaaaatataggaacacactagtttatgccttcctttcagtgcagagattggtctgccattaattttaaatgtcaattgtggtttcttattactgtcccacaccctttttgcccttattttttggctacaggtatacgttagatactttgtaatctttaaactttaatgtttaatgactgttaaagattgagatgaataccagagtctgctcctcattttaataaaaccttcaagttctcatattaatgagtttactatgtagctggttagctaagtctgttttatttcaatagaagtttaaaaactggcctgaacatattaaatgataatactaagctgaccataaggatcaacaataattgcacataaaattgatcttcagttttagttctgaacatctttgcatcaaaggtaaaaagagaatattgttagttgtaaaattattaccagaatagagggagcatataagctccttagaggaaaggacaaccttttttccattactaacttgtcacaattctgtaactgagacaccgatcctattctccagaggtaggcactgattatgtttagtgatttaatcattaagtatattgtatttagtcattaaataattgcgtaagaactttttacttgcatgagaggtggaggttgcagtaagccaagatcgtgccactgcattccagcatgggtgacagagggaaaccctgtctcaaataaataaatagtagccacttaaaaaattattactattctaaccaaaactgataactaattatatatttatatatttatatttatgtttacttaattatatatgtacttatatgcttatattaagctgtgttttcctgaaaacaatccatatttaatatcatttaggaggcatgctaccgtttaacctactgactataagttacatcattttatctctactaaaaaaaaaaaacaaacaaaaaacaaaattagccagatgtggtggcacatgcctgtaatcccagctacttgggaggctgaggcaggagaatcgcttgaacccaggagggggaggttgcggtgagccgagatggcaccactgcactccagcctgggtgacaagagtgaaactctgtctcaaaaaaaaaaaaaaaaaaaaaaaaaaaaaaaaaaaaagataaattcctgatatttcatctttttgaatttactgtttctagcaaaagatttttgtgactaacagtagttttcctactcttttgacctctttttgtagatcttaaaatgggtggagaggaaaatttagatacgtaaatgaatggagacttatttttttattttatttttgagacagagtctcattctgtcgcccaggctggagtgcagtgatatgatcttggctcacagcaacctccgcctctcgggttcaagcagttctcatgcctcagccacccgagtagctgggactgcaggcacccgccacccaccctgctaattttttttgtattttgagtaaagacagggtttcaccacgttggccaggccggtctcgaactcctgacctcaagtgatccgctcacctcggcctcccaaagtggtgggattacagacaggcatgagccacaacccagcctgtaaatgaatggagactttaaaaaaaagcgtttggtggcattacagcagaaacataaatcttcatatttaggctaaattaatcagatttatcaaaggttaacattatggttccagttactcaaaatagtaagtttgatgctttaataatttgtttcttattgcttactaaaataaagacatctgttagtgttctagataggaaaatatattatttgttcattttaatttctttctcaacattttcacttccacttttcataagaaatggtattctgaaagttgcgttttgtaggccacaatcattttttctctagcccttgtatagtatggagttacccctctggccactagatggagatcctgtttcattttaagaagtatttggtaatattcacatgttaatgttaacaggcagaatgttactttagagaccctcacctattttagaaaatagtatgttccttttttgagaagagagcatattaagtctcagcacacattaaattatttgccattaacttagtggggtatgctacaaattcttattgaaataaatctttacctttttaatagtggtcttattatatggggatgaatattctttcagattatcaagggaaattgctgttatctgggttaatctgacaattcacagattagaaaagaacaaatgaaatctagagaaatgtattcagttgctcaagtttaactggttagtaacgtggtgattattaaactcacttattttcaagttgaaaagcaagatataaatggattttgtcattatgaaaaataaaaatgagtaagtgatgtgttagagtaaggtagacatgagagagcaggcacaggacttcattgggaaaattataaagtatctactgaattggctggttatcttagttaaatgatgttatatactaggattaaaatttttaatttccctaatattggtttgacagttttataacaaactataatgtgtcaaaacccattactgcattttgatataccatctgatttttctcacagtgtattttgtatgtttaaagctcttttttttttactttatgttacctttggatatgtttctttaagagtaggtatttaatttcataagtatactgtttgagaataaggttaattctgttgtcacgacaaatatcttaatttaaatatgaccatatttattaaatttgaattacttagtagttacatcaaagtaaatgtgcagttggaaacctagccatcttgctaggtctcagggctctccaaattaaaaaggacatagaaattgtattagtgctcttacaggaaaagataaggtttgataccaatagaaaatacataatttttattatttataaaaatactttattttgttgatatacactgcctgagaaacaaataatgaaaaattgtcgagctgtcgtaacatgatacttaactgtatatccttatttatagttttcatggtaatagttcatatgaaactgtcaaattatgccatttctttgtactgttttaataaagagtctgggagctgtggtggtggttcatgcctgtaatccctttgggaggccaagatgagaggattgcttatgcccacgagtttgagatcagccttggcaacacagtgagacttcatctctattaaaaactaaaataggccgggtgaagtggctcaagcctataatcccagcactttgggaggccgacccgggcagatcatgaggtcgggacatcgagcccagcctgaccaacacggtgaaaccccgtctctactaaaaatacaaaaatagccgggtgtggtggcgcatgcctgtaatcccagctactcaggaggctgaggcaggagaatcgcttgaaaccccagaggccgaggttgcagtgagccacaacactccagcctgggcgacagagcaagactccatctcaaaaaaataaaaaaataaaaataaaataatctatcagattattctactaattagagtagcaggccaggtgtggtggctcacatctgcaatcccagcactttgggaggctgaagcgtgaggatcaccagcctgggcaacttagaccctgtctctacaaaagaacaaaaaatcaacactcgcctgtagtcccaactactcgggaagtgggatcccaggagggcgaggctgcagtgagccgtgatcataccactacactccagcctgggtgtcagagtagaccctatctcaaaaaaaaaaaaaaaaaaaggtagagtaacctgccactttatttttagcccaaagtatattttaatagtattttaatatggctctagtttttgtgacagttagctgagcagtaccaataaaaattaaaacacttgcctatgtttaatgtatttatttctatatatggtcactagcaaggcatgttgatagcgactcagagtatctataacgtaagtgcttatcaacaaatgttaattccttttatttagagttttcatttttgtcaagggcatccaatgtggaaatgactttggtatagaatatatgactctgtgttaaataattatgactggtaagttttataaggggaggacaggttgcttaaattaaaatttagatgggttttgaattgctttgatttgtacagatttgtaaagttaaagtattagttcacatctcagacacttcagggataccattcttgactacccagcgtagtcctttctctcctatgagctgctcacgtacctaatccttatattgtcacctttcacactgtagtccagctattaagaaaagcttaatcagatttccacataactacctaccagattagccataactctccatttcttctatgaaacatcccagttaagagtgagctgtgtttgtttccagatttgtttatgccagttgtatttccgctatataattgttttgcaaactagatgtttttatggtaaatcatgaaatgctttaaaaaagtcctacaggccaggctcggtggctcaagcctgtaatcccagctctttgagaggccgaggtgggtggatcacctgaggtcaggagttcgagcccggcctggccaacatagcaaaactaaaaatacaaaaattagccgggtgtggtggacgggcacctgtagtcccagctacttgggaggttgaggcacaagaattgcttgaagccgggaggcagaggttgcagtgagtcaagaacgagccactgcattccaacctaagtgacagagcaagactccatctcaaaaaacaaaaagaaagaaagagttactccagtttacttagagaatatattaaaatgttaacaatggtagttttattttgtattacccacatttatcagagaaataatgtcaatattttattgaaacaagaaagtttcttttctatgtagtctttatttttctatgtggccttatctttacaactgcttaactaccaaaagtcacgctaaggctcatttctttggagttactaaaatataatttccaaagacagtttttaaaatattcagtgttcattaatgctaactaaaacttcatttttctaaacattttcatagtcttctttcctatactgactaaatttccctttcctgtattcagtagattactagaggcttaaggaaaacacaaacctaaatgcagttttattttaattaatgtgtattttatatgtactcttagaaaaatggttgtagcatttttgctgttgtgtcttgtatacgttactaaatcttgtatgttttggagtagtccatcttcagtgtccatattcattgctttgtcctgtttttttcctctgtgtaaagttaaaatttacctgtttgctttgttataattttattcctcaaactggaagcatcatatagtaattgctcttagagcaagggagttaccctgggatgtatgtcttaatattctggaggtgtgcttttaaaggatagtttctaaatctttcttgttagagccaggttttgccctgaatgcagtcccttgaacgagaccttcagagtgtggtatggatgtagaccaaaacaatcactaagaggttaagtactgttccagctatacctaacatagtcaagatagattcttctttttcttctcttcttgcttcttaacatcttctgctgtagtgatgacagaagtaccagttttcccagaaaatgtcttcatctagagaaaaagagaatgattgtgaagcaaattgctagaaaatgtatttattacaaatactagtacatactagaaaattgctagaaaatactagtaaatactagaaaattgctagaaaagaaatactagctagtaaatactagaaaatgtatttactagcagagagctagtaaatgtatttattatacatgttgcatttcttgcgtagtttttcagtgtgcagtcctactttagtctgttaacgtgttggaaaatgatagtaaatgagtgtattttaatagaatttaaaatctgttgtttttaacatttgggctgaagagccgaaaatataatgaaaatgtagaagttagattctgccatttacgtattctgtatttacttagatacttaaaaatttttacgtatctaactaggctgatgtatttaatgtgaactgcaatttatatacaaaaaactacacatacttagtgtatacaattcggtaagtttagaacatcaactcctttttaaagcaactcttttggggagcagttgagcagaatagggatttaaataattttttcctttgaagattagaggatcattgtgtcattaattttataatctagtattgaaattaattccattttactaatattttgaaaaagcaattaatagcagagtttatctcttaataaaagatttatttccacagattaaacacatcacatatttaagcttaaaataatggagttactaaatgtcagagttttaaaataattaaaagagaagtgctgcttaccctacattgcatcaggagtaaagtgttatcagatatgttgctttagtccacaatagtgatgaatgaaccttttctcttcacggagggcttgtgaacaaaagctgaacaagcttcatatcaaagatggcaaatgttttcagtatatcctgaagggatgtatcttcgctgttagtaatctgtggtaaatttcactgtaactatttgatgtaaattgctagcctctgcaagtaagtcacactgtaaataggctctattttttagtttttttaggttttttatatgctgaatcacatatttcctccaaaatgctaatgtttatggttatttcttttgaattttctgtctgatgaacctttacactgttctttttcttttcagctgtttgaagatacttttccccattgaaatgttttagttccaaatgcagaaagtgattttattcctctccctactaccagttactactataaaaatgaaaaaaattgtttattggcataagttttgtaatgtcacacacccgcatctgtagctgttgatgacaattccaagatagtcttcaagctatgcataaatcagcaaacaggcccttttgaggattggaaggatagtgacttcacttgcctggttgtaagctgtaacactgattaaacatgcatttggtgcttgctgagtaaaggagctgcaagctgcacttggagacatggtgttgcataacagcgtgttgtgcctctgttctttgtcaggcaggcgcacattgaatcctgtaataacaatgaagtatgtgtaaaggagctaaatttgaagacatctaagggttttctgatgaagctcttcatggcaaaaatagaatgaaagaattcaagattgaagtagtttttatgttgttttgtgctttaacaggcaggtttttattaagggtttattatctttatccattcttgttgcttgctgaccaccggtacacattaatttacaataaaagcacatgtcttaaaaggagagcataaatcagctctacattagttttccaagttctcctcttggttgggggggtcttcaaaatctttaaaaaaaaaaaaaaaataaggccggcacagtggctcacacctgtaatcccagcactttgggaggccaaggccggtggatcacctgagttcaagggtttgcctggccaacatggtgaaaccctgtctctactgaaaatacaaaaaaattagccaggtgtagtggcgggtgcctgttatcccagctgcttggaaggctgaggcaggagaattgcctgaacccgggaggcggaggttgcagtgagccgagatcacgccactgcactccagcctgggcaacagggtgagacttcatctcaaaaaaataatgacaacaataataataaatccgatataaataacacatgtcaggttccagacataggcatagattgtcatatgcattaatatagaatttgacttaaagaaaagcatacttacgtaactaatggttgtcaagaaaaatacagaaatacaaaaaacttgatatttttagtttaaaatgaagaaatttgatatcttgagatattttttaaagtacagtaatgaaatttaaagttctttttaaaattttaaagatttttgtaaaataaacacacaattttatctctcacattttttggactattcccagtctcgtgtgccagtgcttattattaccttgttttgctagcttttgccttcatactccttgatatgaagagaatatcttcttctatttccataatgtaagattcccagttggcctctcctaatgctaactcaatagagtaaaatatataccagttaaataagagggaatagcatgtttcatttatttcagaggagctgtgttgttttctctatgcccttttgtttacatgtgaatataatgtaactatatattttttcttttttcttcttcagtcatagtcttctctgccacccgggctggagtgcagtggtgtgctcatagggcactgcagccttcaattcttaggctcaaacatcctcctgattagctgggactacaggcacctgccaccatgcccagctaagttttaaaattttttgtagaaataggttctcattatgttgcccaggctagtttcaaaactcctggccttaagcaatcctcttgtctcagcctcctgagtcactgggattgcatacataagccactgtgcccgacttttttttttttatgcaacatctcgtgctttataaattgacctgcaagtaggccgggggcggtggctcacacctgtaatcccagcactttgggaggccgaggcgggtggatcacgaggtcaggaggtcgagaccagcctggccaacatagtgaaaccccatctctactaaaaatacaaaaattagccgggcgtggtggcacgtgcctgtagtcccagctacttgggaggctgaggctggagagtaacttgtacccgggagacagaggttgcagtgagccgagaccatgccattgcactgcagcctgggtgacggagtgagactacatctcaaaaaaaaaaaaattgacctccaagtaacatacttttttttttttttcttttttctttttttgagatggagtctagctctgttgcccaggctggaggacagtggcacgatcttggctcactgcaacctccacttcccaagctcaagtgattctcctgcctcagcgacctgagtagctgggtctacaggcgtgtcagcacgcctggttaatttttgtatttttagtagaggctgggtttcaccatgttaaccaggcaggtctgcaacttctgacctcaaatgatctgcccacctcggcctcccaaatatctgggattacaggcatgagccactgtgcccgctcatgagtgatatactttctaattagtattcattaattatgaaatttgaaatcgttcgatttcattttattttgatttttttttagttgtaaattatattcaaggttttttttgaacctaaagttttttttaaagtttctgggattatcttttatgtttatatgaagaaataatgctttaatcatgtatatatatatatatatttatttatttatttctagattttgctgggggcagtgctcacgcctataatcccagcgctttgggaggctgaggcgggcggatcacgaggtcaggagttcgagaccagcctggccaacatggtgaaaccccgtctttactaaaaatacaaaaactagccaggcgtggtggtgggcccctgtaatcgcagctactcgggaggctgaggcaggagaattggttgaacccgggaggtgaaggttgcagtgagccgagatcatgccattgcactccagcctgagtgacagagtgagactccaacttaaaaaaaaataaaattattattatttctagattttaacaattggaattatcagttatatttgtgcttgcaaatttgtgggatctctttttccccttctcttccttattgaactttagcatgctagactgtcttcattattcatgtatggagaagaagattctcattttgtggttttggttgttcttaataccttcataataatttaatttttaaaacataaacatatcttgtattacttgtattcttttataattttatctaaattgctgttgagtatttttaggttcacagaaaattgagcagatagtacagagttcccatatatgcagttcctactcacagtttacttattcatattttgcattagtgtagtacatataattgatgaactaatagtggtatgttatttttaactaaatttatagttgaaattcgagttcgctctttatgttctacagttgtgtgggttttgacaaatgcgcaattttatgtattccaccatgacaggatcacacagaagagtttactgccctaagaaattctattaatcctgcatcccttcctaatccccagacctctggtaaccactgttctttgtactgtctccatagttgtgcctttttcagaatgtcatatagttgtaatcataagatctagccttttagattggcttctttcatttaataatatacatttaagttttgtccatgtgttttcatggcttggtggctgcttccttttttatcgctgaaaaatattccattgtatgaacatgtaagtgtttattcattcaccttttgaagaacatcttgattgcttcctttttttggcatttatgaatagatctgctataaacattcacatacagatttttattcccagttttgtttcactgatctatttgtttattctttcgtgagtaccacattgtcttaattgtcgcagcattatagtcaggtggtcaagtcatatagtgtcagtcctctgactttgttcttcaatgttgtgctggctatgctacgtattttgcctttccatagaaacttaatcatttgattgatagccacaaaataacttgctggggttttggttggaacaatgtgtcctctgttctgtttctctttgtatgttacatgaagagggttgagaacggtgaaatactatgtgcactactttgctaaatgagtttataaagcagtgcaaatggtaatctttgggtacctggctatatttttatcagtataaattctgatttttcaaatatttcgatgtagacagggaaatcattcaaaactgtggattccattccagcagatgtagctaaaatgggggggcaggagaaaactgtggaatagggaaggttttttctaaggcttcattattgtgccagtctcaagttgaaaagaggctacatgattgtacattcaagtcttatgttttcctatatttgaaaaataaaaacatttataaaatatatgcaatgtttactgggtgcttttcctcgtattagtgttttaaagcaattgaagaaaataaatatttcagtataaaaaggagcaaatgtatatgaataagtacttaagagaaaaaaattttagtgacagctttaatggttgataattcggtacccttcagttcacccatttaaagtatacaattcattgatttttattatagtcacaaatgtgtacaactgttaccaaagtgaatttgataatttttttttttcacctcataaagaaccctgtacccttggccaggcacatttgctcatgcctgtaatcccagcactttgggaggcccaggtgggcggatcacttgaggtcaggagttcgagaccagcctggccaacatggtgaaccttgtctctactaaaaataaaaaaatgagccgagtgtggtggtgggcgcctgtaatcccagctacttgggaggctaagacaggagaatcgcttgaacccgggaggcggaggttgcagtgagctgagactgtgccattgcactccagcctgggcaacaagagtgaaactctgtctcaaaaaacaaaaaacaaacaaaccctgtaccctttagttatcatcttccatcccctcatcttctctagcactaagcggctgataatctactttctatccttatatagagttgccttttctgaatattttatgtaaattggatcatataatatgtggtctttttaaattggctttttccatgcagcaaaatgttttcagggtttattgatgttgaatgtatcagtagttgataacttcttcgggctgaacaacattccattttatggctgtgtactacattttgcttttccatcagttgatgtctatttgtttttgcattttggcagttgcaaaaatgttgcagtgagcattagcatacaaatatctattggtgtttctgctttgaattcctttggtaatatacctaggatggaattgttgagttacatggattacctgacttttaaaattacaataatcttactgggtgtgagatggtatctcattgtggttttaatttgcatttctttgatgactaagtatgttaagcatattttcatgtgttcattgactattcacctatcctttccagagaaatatcttttcaaattctctgccccatgagtgggggctggctagaagaggggattgaatgtcaacttcttagccatgtgtaccttctaacttagcagcaggaggttgctgtggtaggatgggaaatgctgacatcctgcccctcaccccgctaggaaggcaggctttcagctctgtactaaggcatagctttccaacttggacctctgggagagggaggcctgtgttcttggctgtagccagctagagtggtttttctttctcattgagctgagggtggggaagaaaggagcagcatcttgattcacataccacagactcttgcttttcttactgagttttagtacattttcttgaataaacgtttcttcatttgctgcatactgttaggaccacttccagagattttagatagttgtgttcttttaaagagtatgtaccagtttcactggggatctgatctgcagggatcttccctctcatgctagcaagaaaaattgagttctcataaaccaagtaaaatattcaagctttcctactaattaaatgttttagaaccttacagtggaatattttgtatccatcaagttcttgaaagtagaaaccatctatcttgatattgggtagaaagaggaagttagacactatggagtatctagtttttataaaattcaacacatacctaaatatacaatatcatgtacttctcccctataagacatattttattaattaaattacatcaggtttttcttaagtattctgttctccacattttaaaattcaaaagctttaaggtggtatctaataaatagctgttttcctgcctctgtcctaccaataacagctcattagggataaactatagttatccctatagtactaatctaactaatagtactaatagttacagatagtactaaccagtgctactaatttcttatatttctttataggaaatctatgtataacaagtaaatataaatacatattagttcattgtcacactgctataaagaactgcctgagactgggtgaattataaaggaaagaggtttaattgacttatagttctgcagggctggggaggcctcaggagacttacaatcatggcagaaggggaagcaaacatgtccttcttcacatggcagcagcaaggaaaagtgcagagcaacgcagtgagagccccttataaaaccatcatatctcgtgagaactcactattatgaggacagcatggaggtaaccacccccatgattcagttacctcccactgggttcctcccatgacacatgggggttatgagaactacaatgcatgatgagttttgggtggagacacagccaaaccatatcacatagtctccctctttttatgtttttgttatttgtgttttgttttatgtttacccaaataatcatttattttttattaacatttatgggttatgtttaccatataacccatttttataccttactgtcctatccccaccccaaaatgacattatagtacttgcgaatttgctccagtacagcataaagcatattctaattttttatggctacataatgggcatttagtaattaaaacagttgcatattaataaacataaataggttcttttttgagataaggtctcactctatgtcccaggctagagtgcagtggtgtaatcatgactaactgcagcttcccatgcccggctaattttttaaattttatacagacaggatcttgcccaggcttggagtacagtggtgtgattatggctcactgcagcctcgacctcctggactcaagtgatcctgccacttcagcctcatgagtagctgagactactggcgggcactaccacacctggctaatttttaaaattttgtgtagagattgggtctttctgtattgcctaggctggtcttgagctcctgggctctagcgatgcttctgccccagccttccaaatcctgggattataggcatgagccactgcatccagctcacatatttttttaattgacatttttattctgttgtatatgcccattgtaaatatgatatacctgtttattgagactatcatctctgtcctgcagcatagatattttcatcataagtttttttgtgtatttttgttgtatttcctattgtgcagtttctctattttacagttgattgttatataaaattaacagtattcatttatgtgaattttgcatccacatactttagtattctaatagtatttctgtggatttaccgtattttccaaatagagaatcagttttctgagaatgaagacattactcttttcccacttctttttttgtttgtttgttttgaaacagagtctctgttacccaggctagagtacagtggcatgatcttggctcactgcaacctctgcctccagggttcaagcgattcacctgcctcagcctcccgattagctgggattacaggcgcacaccaccacacctggctgtttttgtatttttagtagagactgggttttgccatgttggctaggctggtcttgaactcctgatctcaggtgatccacctgcctcggcctcccacactgctgggattacaggcgtgagccaccacacctggtctacccacttcttatgcttttttaaaaaaatgtttttcttttggggaatccccatatccacatacctttcctggcttgtatttataaaacagaatgtcaggaatttgtctcttgaagatgctactttccaaaagaattttttgttgtgatgaaaacactctgtatctgtgccattcattaaggacttgtgtggctatgggacacttgaaatgtggttagtgcaactgaagaactgaattcttagttttcttacattttagttaaaatttagatagcgtgtggccagtagctgccatactggacagttcaggaagtatcatgggataatgggaaaagcactaaagctaaatgtaccaagttttcactgttggtcttcttacttcctatttagctgcttgtgcaacttagtaaatattagtttctcatacacacagtggggatgataatacctaatccacataatagtacacacagagaaacatcatcatatagaaaatggattagatggatgtataccaaaatgatgtaccaggtaaaagagtggggaaggaggccgggtgtggtggctcacgcctgtaatcccaacactttgggaggttgaggtgggtggatcacgaggtcaggaaatcgagaccatcctggctaacacagtgaaaacccttctctactaaaaataaaaataataattaaaaaattagccaggcatggtggcgggcacctgtactcccagctacttgggaggctgaggcaggagaatggcatgaacctgggaggtggagcttgcagtgagtcaagattgtgccactgcactccagactgggcaacagagcgagactccgtctcaaaaaacaaacaaacaagaatggagaaggagagaaatagtcaaaagaaactatagccttaaaaggtaagttttatctttttttttttttttcaggataatctatttgaaatattaatcactgtaatcgtaacacgttaggaggccaaggcaggtagattgcctgagcttaggagttcgagaccagcctgggcaacatggtgaaaccccaactctacgaaaaaatagaaaaaattaactggacatggtggcatgtgcctgtaatcccagctgctctggaatgtgaggcaggaggatccttgagcccaggaggccaaggctacaaagtgcaatggttacaccattgcactccagcctgggcaacagagtgagaccttggcgcaaaaaaaaaaaaaaaaaggaaaataatataaatattaatgtaaagttattttttagaagttcaccttttttggctgggcgcagtggctcacgcctgtaatttcagcacttcgagagttcgaggcgggcagtcacttgagatctgtagttcgagaccagccaagccaacatggtgaaacaccatcttgaccaaaaatacaaaaattagtccggcatggtggcatgcacctgtaatcccagccacttgggaggctgaagcaggagaattgcttgaaccctggagacagaggttgcagtgagccgagattatgtcatagcactccagtctgggcaacaggagcgaaactcagtctcaaaaaaaaaaaaagcacacatttcttgcacatagtgtgaagtctggggttttagtgtacccatcactggaagagtaaacattgtacccagtagatatttttcaaaccccactttttggaggagtctcccatgtctctctctttttttttttttttttgagatggagtctccctccgttgctcaggctggagtgcaagtgcagtggtgcgatctgggctcactgcaacctctgcctcccaggttcaagtgattcttgtgtctcagcctcccgagtagctgggtttacagacacccacaacgaggcccaggtaatttttgtattttagtagagatggggtttcgccgtgttgaccagactggccttgaacttctggcccctagtgatctccccacctcagcctcccaaagtgccgagattataggcgtgagccaccgcacttggcctgtagttattcttatagagaccttttacttccttggttaaatatattcctaggtattttgttttagattttattattttatcttatttttaattttatttgacagggtcttgctccgtcgcccaggctagagtacagtagtgctatcagagctcactgtagcctcgacctggtaggctcaagtgattctcctgcctcagcttcccaagtagctgggactacaggaatgaaccaccacacctgactaatttcctttttggtttttgtagagataaggtcttactatgttgttcaggctggtcttaagcccttggacccgagctgtcttccagcctggacctcccaaagtgctgtgatttcaggcatgagccaccacacttgttcatttttttttttttctgtagctattgtaaatgagattgctttcttgatttaatccttggctagatgattattggtgtatagaaacattactggttttcatatattaatcttatatcctgaatctttattgaattcatgtatcaaatccaagagtttctcatggagtctttagggttttctagatcatatcctcagcaaacagggaaaatgttgacttcctgctttttgagtttgaatgccttttttttttcccttgcctgattactctggcaagatgtccagtacgatgttgaataagagtggtgaaaatgagaactcttgacttgttccagttcttagagggaatgctttcagctttttcccattaagtatagtgttagctgtgggtttttcatatatggcctttattatgctgtgtgttccttctatgcccagtttattggggatttatatcaattttatcacatgctttttcaacatttattgaaatgactatagagtttttgtcctttattatgttgttatgatgtgtcacatttatggatttgtgtgtgttgaaccatccttgtatccctgggataaatcatacttgatcatgatgtattatcttttttttgttgtttattttttaaaagttatttatttatttattttgagatcagcttgtgagactggctaatttttttattttgggtagacacagggtttcaccatgttggtcaggctggtctcgaactccttgcctcaagcaattcactcaccttggcctcccaaagtgctgggattacgggtgtgagctacagtgcgtggccatttatttgtttgtttgtttgtttgtttgttttgagatggagtctcgctctgtcacccaggctggagtgcaatggtattatcctggctcactgcaacctccactttctgggttcaagcgattctcctgcctcagcacccccaagtaggtgggaccacagacttgcaccacaacacccggctaatttttgtatttttagtagagatgggtttcaccatgttggccaggctggtctcgaactcctgacctcaggttttccacccaccttggcctcccaaagtgctggagttacaggtgtgagccatcacgctcggcctatttgtttatttttaagggttgaggtcttgctctgttgcccaggctagggtgcaatggtgtcatcgtagcccactttagcctcaaactcctggtctcaagcagtcctcccaccttagcctcccaagtagctgggaatacaggtttttgccatcacatctggcttattttattttattttattttatttttgtggagacaggttttcttgctcttttgaccttgcttgtctcgatctcttggtctcaagtgatcctcctgcctcagcctcccaaaatgttgggattacaggtgtgaaccaccatgccattattgtattatctttttgatgtgctgttggatttgatttacttgttttttgttttggatttttgtgtctgactttattagggatattggtctttagttttctgcttttattatatctttgcctggttttggtatcagcatattaccggcctcataaaatgagttagagagaataaactcctccttaatttttttagttttgggaggacttgtatcagtatgttgtttttatatttggtagaatttggctgtgaattcatgtggtcctgggcttttttttttttttttttttttttgttgggagatgttttattatgattgaatctcactgcttgttattagtttgtttagaaattcagtttgtttcttgttcaatctcaggaggttgtatgtttccaggaatttacttgtttcctctaggttttctaggttgagtgtagagttgatcataatagtccctgatcttttgtatttctgtagtatcagttgtattcctttttcatttctgattctgtttatttggatcttctctcttcttggttagtctagctaatagtttatcagttttgtttatcttttcgaaaaccagcttttcagtttgctgatgctttgtatatttttgttgtggggggctgtatttcatttagttctgtgttattctaactttgggtgtggattgttcttacttttctagttccttgaggtacatgtaagattgttgatttgttacccactttctgatgcaggcttttaaggctatacacttctctctctttgcactgcatttgctatatcccacagtttttctgatgttgcgtttcattttcattcatttcaaaaaatttttaaatttgccttaatttctttgttgacccagtgatcattcagtatcatgctgtttaatttccatgtatttgtactgcttccaatgttcctgttggtattgttttctagctttattccactgtggtcttgagaagatacttgatatgatttcgattttcaaaaattttgttaagactccttttatggactaacgtggtctgtctaggagaatgtttcatgtgttggtgaaaggaatgtatatactgtcattgttgagtagactgtcctacgtctgttaagtccatttagtccaaagtccaatttaagtccaatgttttctttgttaattttctgtctcaattatctttctagtgctgtgagttgggtgttgaagtctcccactattattgtattactgtgaatgttattgtttgattatggtattactggtagatcatttccagctttccctattgaaaacagtattgtattgaacatttctttgtagggtagacagtaacaagtgctattattgagtcatagaatataggcatttaaaattttaatagataatgccagttggctatacctgtttgcgcttttacctatatgtgagtctagcttttccacatcctcacaagtactgacattgtgttttatgcctatcagttagtaacttttggatataattttgattttcctgaataacatagtatcttataatactataaaattatagtaagtaggatgttgtgacattgttcatgggttggaaaatgggctttcatactcaagtatatgtggaaacaaggggaaacaaggaaagaatggcagtcatactaccctgtcctctgcatcatcactggaaggtgtaaaatgaccttctcttccatcactttgaacgtcactccaagtagcctcactgtcattaagctctgatagtctctattttacatcagttgtagagatctctttcacatcagttaccatacaaagtacaggatgctaggtgatgccacatcctgttacaacttaatccccatatagctctgtgggcactgaggcaattcctacctctagttggactcccacaattctcctcccctgctttagttttctatatagcattcagaatacttactagcttctgaaaagaatgtaactcatgtccttcgcctagaatgttagatacttgatggtagagatttttgtttgttttctttactgcttattcccagcctgtccagcaacaggttttcagtaaatgttttttgtttgtttgtttttgagactgtcttgctctgtcacccaggccggagtgcagtatgtggtctcagctcactgcagcctccgcctcttgagttcaagcgattctcctgcctcagtctcctgagtagctgggattacagacctgtgccgccatgcctagctaattttcgtatttagtagagacggggtttcaccatgttggccaggctggtctcgaactcctgacccccggtgatccatcagcctcagcctctcaaagtggtgaaattgcaggtgtgagtcaccgcgccctgccagtaaatgtttatggaatggctgttcagtaactgtcattggaagagagatgttagatccttatctcacgttattcacaaaagtaaattccagttggtatacaacacaaaacccaacaaaacaacttataaaagccttagaagcaacgtgtgttcctcgagtaaggaattcactcttagatacaaataattttaatacaaaattcatttgatttatagctagtaattggaagttaacataggcaatattttcttttttactaaaaagaaagttgatttattgaaatagactctggataaattgcaattctgtcattcgttttcacaaaagataaaataacttcatcattcaatttagtttaaaaaagtttccacttcatactgataaatatgtttccagccataatatattatctggtgtatttaatcatttctatatgtaatataactagatatttagttacatttcttgttctcccctaaacttgatactttacttttttttgttttccaaaagtgcctattattatagtttgtatattggtgcttcttaaatatctgctgcattctttcatttagcagctaacctattaagttgacccttgaataatgcaggtattaagggtaccaacccccacatatttgagaatccaagtataactttttctttttttttttttttttttgaggcgggattttgccctatcacccaggctggagtgcagtggcatgatcttgtcctccccagttgcagggactacaggtgtgcgccaccacgcccagctaattttttgttatctttttgtagagatggaagttttaccatgttgcccaggccggtctcaaactcccaggctcaagtgatcctcccaccttggcctcccaaaggtctgggattatgggcgcgaatcacagtgtccggccccaagtataactcctgactcttccagaacttagctcctaatagcctactgttgactggaagccttactgataatcaattaacacattttggatgttgtatgtattatatactgtaaggtaaggaaaagaaaatattaagaaaaaaatcatagaaaatatatttactgttcattaaatggaagtggatcatcataaaagtcttcatactcagagtcttcatgttgagtagcctaatgaggaagaagtgatgaggttggtcttgctgtctcaggctggcagaaaatctgtatataagtggactagtgcagttcaaacctgtgttgttcaagggtcagctgtaatttttttgagacggagtttcactcttgtggcccaggctggagtgcaatggcatgatcttggctcactatagtctccgcctcccaggttcaaacagttctcctgcctcagcctccgagtagctgagattacaggcatgcgccatcccacctggctaatttttgtattcttagtagagacagggtttctacatgttggtcaggctggtctcgaactcccgacctcgggtgatctgcctgcctcggcctcacaaagtactgagattacaggcctgaaccagcgtgcccagccgggtcagctgtggaccttggtaagatccaggtaaaagctacattcctgtggacctacttttatattgtacatttgctcattttgtgctttttcttcttctccttatagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaaggtactatatacaatgttcatttctcttgagtttgcctctaacaatgtttttaaaataactccatgggtgtttttgtttttcagtgatatgtgctttttaaaagcatatacaccctcggctgggtgcggtggctcacacctgtaatcccagcactgtgggaggccgaggtggatggatcacgaggtcaggagatcaagaccatcctggctaacatggtgaaaccccgtctctactaaaaataccaaaaaattagccaggcatggtggcgggcacctgtagtcccagctgctcgggaggctgaggcaggagaatggcgtgaacccgggaggcagaggttgcagtgagccgagatcacgccactgcactccagcctgggtgacagagcgagactccgtctcaaaaaaaaaaaaagaaagaaacatgcacaccctcacacacaagcaataaataaacatacaaagaaaaagtatccacccaaattatacacttagaaacatttattcacaattgcttattcagtatctccctgtgtgatctcatagctataggtatgaagtttttcccaaatggtgtcccattgtacctgttagacaaatagatgctagtttctcacataatgttgatgtcagagacatctttcagtgtcaataaataccactgacattgttctaaatacttcaaattcacctttgtatttaggtgctatattttatttaactatttattagtagattttaggttattttcagttcataataacctcatacatacatcttttggtgcttgcagaaatctctgcagatagaatcttagaagtataattcttaggtttatggattacttctgttttattttagaagtcaaaggattcagtatttgatggaattaaaataagtcttaatgcttatctttaaggaaaactgaattgttatttttagtttgtttacaccttagtagattcagaggatgagttctgtcaaaactcttttttaaataacctaggagaccttttcctttcccttggcaggatctgttcagtgaccttttcctttctcatggcagaatctgttcagtggttgtcagtttattcctcaaagatggcctaattctgaattttgaagcatttatactgttaatggaagtttactcctttttcagttaccttttgagtaaattaatgtcatttaccgtatttactgtatttactttgctttttctcacttattttttaagaacctatgacttaagaaatagtgtagatcaaaagatcatagagaattggtcactggaagaataattcttgttagtctttgcctatgagggagaaatcaccttgtgaaggaattctgactttgttggcttaatgtgttgtcattatcactttattcatttattttaatagcttttggcatacaaatggtttttgattacatgggtgaattatatggtggtgatggctcattgccaggcagtcagaatcataaattatagaaaagatgaaatgaagagccagttggtagagataaaaagttgtagactcatacaactctgttactagtaatggaaaatgtaaaggtatattttctttgatagtgtgatattttttcttttgtagagaagagaatagtgttgtatttggtcccctcctatcttgtggccccccccagaatctttctcactggtaaccaaggaagctagtgtaataatataacaatagtgtggtatcataattgaactgaacatctgattgtctcattgagctaatgcctccttgagaagtgtctactaaaacatcttattcccttccctggccatctgtgttgcttattcttgtagaataaacatagttttcagtatatcaatatgtataatatatactgagctttgaaactgccatcatgtctttttaggggaatcttgccctgtatttctgtaccttacatttctgtgttttgagatgactctgttagcttataactaaaattgaaaatttataaaaccttgagtgttttttacccaggtatattttgtcttttagatgaaaaattgcataatgatttggaatgttgttttaggtttagccttgattaaaaacagtatcacacatttatagtgttacaaagtgaaaataaaaccagtaaataataatatccttctttaaactgtgtatttccttatgctataatttctattagatcctgcaaaaatggagttatagagtattgaattctaaggtaattatagaatattcttattgcaggaaatttggacacctatagtgcctctttggtctatttgcttttcttagcttaatctatttcctgttcacataacactgtataattttttgagaaaggaatcttctttataaaaatacaccagttaattcaccatgaaaatttaatttcagatagaggataactgagtttcaattaactggagctctttatttttctatttgattaaccggatgaaattattccatttaaattcttttattcttcagccagagaacattcttcagacttataaactatgtaccaacaaaatatgcatgtgaagatataatgagtgttcgtaaagctcatttcattagattattttatctttacagtgaccgtgtgcagtacatatttttagtaattctttttactgataaacattattatattttgcattaagacttgaatatactttttcgttgaaaccctcatggtctctgctaatctgtgcagcctctgttataagacggcaccggtaaagactaataatgttactacatctctactttcaaggtttaccatatagagaattcattttcagcttcacagagagagtaaaatctattcttttccagttgtcacaacttaagatgtatttttttttctaacagagttcacaaaataatccatttttcccttacagtgtatacccacagaaagtggccttagtttaattttaacactgactcaaagctccccaccccacctgtctgcctcattcccaactgtatttcacaaaaatcctagaatactctgagaagagaatgattcaggaaaatgtgttctgttaatgtatcactttcagggtctattttagtgttttttgagggtttggagctgtaactttaaaaatgctgtgtatcacggccgggtgcagtggctcacggctgtaatcccagcactttgataggctgacttgggctgatcacttgaggccaggagttctagaccagcctgtccaacatagcaaaacccatctctactaaaaatacaaaaattcagctgggtgtggtggcacatacctgtaatcccaggaacttgggaggctgaggcacgagaatcacttgagcctgggaggtgggggttgcagtgatcacaccatcacactccattacactccagtctgggcaacagagggaaactctgtctcaaaaaatacatacatacatacatacatacatacatactatgtatcacacactcagaaacattttacaatatttctgtctctattactgtgaaatccaagggtgaataaagtacatgtatttggtatggttctttttttaagtaagagaaatcgtagtttactacttatttttatatacctaatatatatatacacttaatatatatatatacctaatatatatatacctaatatatatatgtatacctaatatatatatgtatacctaatatatatatattagataaagaaaatagattcattgtgtattctgcagatctctaggtagtgattgtggttgcatataatgattttcattgaaatgatgtgtatgttgtatttgtaatagaatttttaccttccttttggggatgagagaaattaaagaaaaaggtcaagtgtaaagaggatgttaactgtgactgctgagaatatcctgtctatcttgaaatctatcctgaggccactgcctaaacccaattaattttgatctgataattcagagaatggaggagattccataggtttgtgcgcccccaagcccaaaacccttacaagaggagataaaaagacatcattaagaatctggatcccagtgccagcactttgggaggcttaggtgggacgatcacttgaagccgggagttcaagaccagccttggcaacatagggagaccctgtctctacaaaacataaaaataaattagtcaatatcgtgggctgcacctgtagtcctagctgctcaggaggttgaggtgggaggatcgcttgagactaggattttgaggttacagtgagctatgattttaccactgcattctatcctgggcgacagagtgagacccactctgcatgtgtaagaacaaaaataaagaaaataaaaaagaaagctggaaaggcttatcatttaccttacatttatctaatttgtaacatattcatgattataagaaattcatgattaacactgataggtgagatctggcctggtcacaaaatcattactgatgcattcacttaacagattttttttttaatgtctgtgggcacataactagaaaattggtcttctttctaaggggctgacatataaatgggggaaataataaccaggcaggtttttttttttttttttggacagagtctcgctctctcggccaggctggagtgcagtggcttgatctcggctcactgcaacctccgtctcctggtttcaagcaattctcttgcttcagcctcccgagtagctgggattacaggcgtgtgtcaccacgcccagctaatttttgtatttttagtagagacggggtttcaccatgttggccaggctggtcacaaactcctgacctcaggtaatccgcccgcctcagcctcccaaagttctgggagtacatacaggtgtgagccactgcgctgggccaacctggcagttgtaacaacatagtatctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgcctgagcatagtgtagctggaaggtagtggtgggagatgagcctggagaggaaatcaggggctagaagataaacaggaatatatcacagagttacttaccttaaaagtaatgttgagccactgaaaggttttcagcagctctcatcaggtttgcattatagaaagatggtcttcaggtgtagttgaatggttggaggggaagttggaacaagaccaaactaccatggaagagactttcatctgttttgtctcagcagatagagctgtatatgtcttctccctgtcctactgttttgggggactgagattttggtactcatcagcactcttgctctcatattatggacttaatagatagttagtttccaggtagaaatatattccatgctccagatatttgtcttaaaaagcaatctgtgttcatattggcaactgcagatttatctctagggatctccttcaatagagtacaagtgccatagcataaatggatctgggaacatggcttcctttgttctcatatacgaatccgacgtctacaatgttaggcagaaattttccaacactaatcctattacttggttatttgacggactcaggcagaaagctatgatccgtcgattgatagaagctaagtcgttaagtcaaaaagcatcttaaatcttttgtattaaggtcctggaatggcagggtgagactccatacatgttcatgtcttcctgttcctctactgtttgcttaaagctgtcacccagctaaagttgtagacatggaacacttatacaacattaaattttgtgtcctatctacccaaatctaaaagagaactcatatgatggtgagatattattaattttattaaataagtcagttttcttgattgaaaactgaaggaaattttcttggtagaaattctttgttagaatgcagaaccttggcatttgtgaggaagaacttttagatgttataccacctatgctactgtttacttaaatttttctttgccttttttttctacttagaatttttcttcagatcaacttaaaaaattaaacaagtttttcttaggcttttaaagaggaaacttcaaattacccccatagcggatggaccattatcatttgccataaataggagacagtgtaaacatgagtgaaccatttactgtgaataaaatagtgtttacttattaatccttgaaatatattagaccatgtgtgcaaagcagtacaatcgggaataatcattcagattttgtttgttaaatgaaacactggaaaaataaatgcatgtccatcaaaaggaggattgtttatactacagaatattcatacatgtaaaattgtgcaacaatggaaaagaaaagtgatctatattttattttatgtatttatttattttgagacggagtcttactctgtcacccaggatggagagcagtggtgcgatcttggctcactgcaagttccgcctcctgggttcaagcaattctcctcagcctccccagtagctgggattagaggcccttaccaccacacctggctaatttttgtatttttagtagagagggggtttcaccgtgttggccaagctggtcttgaactcctgacctcaagtgatctgcccccctccgcctcccaaagtgttgggattacaggtgtgagccaccgcgcccggcctgatctataatttagatgtaaaaacagccagctcttggatgtatcattgaatttttaaaaggaagctgggctggatatggtggctcttgtgtataatcccagcactttgggaggccaaggtgggaggatgattgcttgagcccaggagttcaagaccagcctgggcaacatggtaagtaaaaccctgatatattagttgagttgccttgtacactgtactccttttaggtggtgtgctgtggagtagagtaggtagaaccaatattgcagccatatcactgaactttctgttcatccaaaggttttggtaagaatgactgcttagctgggcgtggtggctcacgcctctaatcccagcactttgagaggccgaggcaggtggatcacctgaggtcaagagttcaagactagcctggtcaacatggcgaaacccgtctctgttaaaaatacaaaacaattagctgcgtgtggtggcacgcacccgtaatcccagctaccgaggcaggagaatcacttgaacccaggaggcagaggttgcggtgagccaagatcccactagtgcactctagcctgtgggatagagcaagactctgtctcaaaaacaaacaaacaaacaaacaaaaaaactagaatgactgcttaaagaaggaactcaggattaacactgtgggattttcttttatgtcttgtagttctcttattatagagttttcactattatatatagtaatgtatcaggtacataattatatataatatctctaatatacatacatacatatatctgaaaagtagcctctgaatttttatttttgaaacagtagactttaagccgtgttttaagttgtcctcaattacaccttaatactaagtgattaatctcttacagtttggtgcatgataattacagtactctgatgggattgatatttagtgtaaactagcgcactgctcaaggaatgagtgtactttttagttaatttcatcttttctgacttacctgttagagtaacctattgacactgtaaggtggcagctaggggtgtttaatggtgatttagtctgtgttttgaaagttgacaattctttaggcagttgttgggtattcactgtacagattgttttaagagcttcataaagatgatgttttaatattttttggttcagggctctgtgtttctgtaatttactatctttcctaataccccctttcaagagtcgtgatttgtaataactgcatggtgttaagtgtaaaagttaacacagataaactgatgaatattgatgttggctggtttactaataaccagaatttgaattaaggccatttctgagatagcattccttctggaggaacaaaagattaggccagtattttatgtcaaaatagagattttacattcaacactttgcattttttgaactagaagacaaggttagagttaagtattctcaggattttcttcagaaattaaaggtgtttttttaaggaatatatgtgacatttggtacattagtttaatagcattttgaatgtgtactttacctatacctataatgctaaaacgtattgtaattttttttccccctgagacagtctctcactctgtcgcccaggctggagtgcagtgacataatcttggctcactgcagcctccacctcctgggttcaagtgatttttctacctcagcctcccaagtaactggaactacaggctcccgccaccacgcccggctaatttttttgtatttttgtagagacggaggttcgccatgttggccaggctgttcacgaactcctgacctcaggcgatctgcccatcttggcctcccaaagtgctggcattacaggcatgagccaccttgcccggcctgtaaatttcacttagaccattcttctaatatcatctgtcacttaaaacctaaagaataggctgggtgcggtggcttacacctgtaatcccagcatgttgggaggttgaggtgagaggattacttgagcccaggagtttaagacaagcctgggtaatataacgagacccccatctctcttctttaaaataatatttaaatttaaaaaaatttttttggctgggtgcagtggctctcacctttaatcccagcccttcgggaggccaaggcagacaaattaactgaggtcattagttcaagaccagcctggccaacatggtgaaaccccatctctactgaaaatacaaaaattagctgcgtgtggtggcgcacagtgggtgtaatcccagctgcttgggaggctgaggcaagagaatcgcttcaaccggggaggcggaggttgtagtgagccaagatagtgccattgcactccagcctgggctacagaatgatactccgtctcaaaaataaataaataaataaaagttttttaaaacctaaacaataaaaagtggagcatatcaggatgctggcattgtatgtttttcttgttcaattaaaattatttttaataatagtttgaatgaaaatggttgattaaaccctaaatattggttctttttaatttatttgcctgtataatgttaagtagttctttattttatttcagaggaattgtttaagaggcttatttcctctacttgcctactatcatattaggcagaagaaaaaaacttagtattcacccatcaaggacttgcactctaggtgagatccattccctgggctagtgtttgaaaattcctgtaaccataaacgttttatttttttagatgcccttaggctggcaatattcaatcgctttgtgattgaaacccctttctttctggcagaaaaaaatataccagattatcattaattctatccccaaagccttagattctggcttacttctttagttttataatttagtcatttttgtatgtaatatttttggggtttaggcctataaagagtgggaggaaatagtttcctaaggaccaagacagaaaaagagacttgaaaagtagcaaagggtatatatcaggtgcaagcaatgttgcacacgggccaaagacaacctgtgaaaagatgtttattgatgcacagactccaagcctcattccataccgattgtgaggactcaaaatttggtgaaaatcaattttagaaatgttctgattgacgacttaggcagatacaaaacaaaattatttcatgcattccttttgttctaccaattaaattttgattagtacaatatttggttcttttgtttttttttttttgagacaaagtctcactctgtcacccagtctagagtgctgtggcgtgatcttggctcactgcaacctccgcctcccaggttcaagtgattcttctgcctcagcctcctgagtagctgggactacaggcgcgtgccaccacacccggctaatttttgtatattttgtagagacaggattttgccatgttggccaggctattcgtgaactcctgacctcaggtgatccacccaccttggcctcccaaagtgctgggattacaggtgtgagccaccgtgcccagccgattagtacagtatttcttttccagcctctgtgctttcatttttttctcttcttgtttcttgaaaataagccaatctgccctaaatcaagcatgcattgtaataaatacatagttgcgtatagttatataagaatataaggagttaataatacagtcctaacttttatgtaggatttatagtttctgaattgcttaggtatatattgatttttctgctctatgtagtgggcaagaaagtatgtactattcttatttgatagaaaatgaatctgttgcttagaatgttacattacaaacttagtaataggtaataaagctgagatttagcttctaagccttctgatactgttgatgttcatcatggaaaacagtattgatgaagaaagatagtttgattgacccatagtctagctacttctatttttatataccactactacccactacccaaatagttcattgatcattaggattcacgcttgtataatggctaaatttaagccttaattggttgttggaaaacactgattaaatgcctaaatacaacttactctgttacttaagtgatttaaaaaaaaaaacaacttaaaaaaaaattataaattgacttagtgtttctgcctcagaagcataacatattagtataaaatgatcactttattctttatcaaatggcattatatgagctttatgtttcacgacagttttcactgtattatctcagacaaaatctcaagcagtcctttttttttttttttttttttttttttgagacagggttaaactctgtcacccaggctatgtggcactatatcggctcactgcaacctccaccacccagagcgatcctcccaccttgacccaagtagctgggactacaggcgtacaccaccactcccggcgaatttttgtgtttatagtagagatggggtttccccttgctgcccaggctggtcttgaactcctgagctcaagcaatccacctgcctcagcctcctgaagtcctgggattacaaatgtgagccactacacccggccaaaatctcaaccagtcttaattactgaatttgaagtctgttgctaagtaaaatttacttcgtagcaggtctttctgggcacattacatttagtaacttgttcatattatctatagattttagcattcgggtagttcaaattccacctttttataaatgagaaaaacaaagttcatacagactgttatttgttctcagttctctgatggttagtgacatagctatgataagaactcatacctcctaatgtctcaaaacatttatctgctaaattaaacttcactcccaaataataattaggtttgtgtgtaaatgattaattaaaaatcagagcatggagcttctgagctggttctaatatttaggatatttaagaattatttttaaggggccggacattgtggcttacgcctgtaatcccagcactttgggaggctgtggcacacagatcatgaggtcaggagatcaagaccagcctagccaacatggtgaaacattgtctttactaaaaatacaaaaattagctgggaatgatggtgcgcgcctgtagtcccagctactcgggaggctgaggcaggagaatcatttgaacccgggaggtggaggttacagtaagccgagatttcgccactgccctccaacctgggcaacagaacgagactccgtctcaaaaaaaaaattatttttaaatgatggcaatgaagtaaaatatttttagttgaaaaaaatctgcttttgggctaagtgtggcggttcatgcctgtaattccagtgctttggcaggccaaggcaggtggatcacttgagactagcctgggcaacaaggcaaaaccctgtctctactaataatacaaaaattagccaggcgtggtggtgtgcacctgtaatcctagctactcaggaggctgaggcatgagaatcgcttgaacctgggaggtgaaggttgcagtgagccgagatcacgccactgcactccatcctgtgcgacagagcgagaatctatctcagaaaaataaaaagagaagaaaataacctgtttttgataatttaaaaaatacatagaataatgtgcattttacagaattttcttactgttttccttttactcatgtgttttcactcccctgaagaatttgtaatatcctatgataggagattaaagggcagcatatttcactaaatatccatagtattctagtcacgtctaattactagattaccaaactaaactgagactcattgtgtttggttatctctctagtatgagcaggtagcaactttataatcacttttatgaagagtaggtcagctttagctgtcgatgtttttcttgcagtattaactgaataagaattaataaggctgggtgtggtggctcacgcctgtaatcccagcactttgggaggcaggtggatcacatgaggtcaggagttcaagaccagcctggccaacatggtgaaaccccatctctactaaagatacaaaaatctagccaggcgtggtggtaggtgcctgtaatctcagctactcaggaggcttgaggtgggagaattgctggaacctggaaggcggaggttgcagtgagccaagatctgccattgcactccagcctggacaacaagagtgaaactccgtctcaataaataaataaataagatttttctgaaattttcttaattattgatggatgtacttttctactgtcttttcaagatgatttggtatccactttcgtagattagggcaatgtcttggtgataaaatggcattaccaaaagaagccccctgctcccacacacacagtattattttccatttcctgcattttattgtggtttaatgtaccctatatttctaatatctttagctcctttgtcaagaagagatggttaaaggatttatgcagcagtacttgatatttaaagagtaagcaaaaacactccccatttatgagtattgttcaacattttattttagactgttagaaaagacagaacttgaaagtaactctcagttacctccactaataaagggatttctggcgtggataacataatactttaaatctgtacatacatattgtttttacttgaatttaaatattattatctattgtgaaaattcattctgttacccacaaaatagtcactctgtgaagatgggaccctttagcatttacaagttagttctggtgaaatttatctcctgctggtcattccagctggtattatcttaagatgaaattaaaatatagccatagtagttttacttttgaataaatatggtatttcatagcttccttcaagcaggaacaaagccttttttttatatctgatcttttgtgcagactttttctgctgtactccaataagcaaaaatcgtatttagtgtagttggtatttgatggtttcaccaaaaatttgagagagaaacttattgtgaataaaaaaatcttatttgctgccagggcatgacacaaatgactctatgttcagtgtaaagtgttctggatatttaacttctctttgaacagcattgaagcaagcatcttttattgccgtttttcctagctatctcaaagtttcttcctaatggaaagttgttcatcatagttttaaataactgaagtcacttgtacaagtaccccacttcctttttatatacctaagcaatgggagatcacttgatttacatctttcaaggcatattttctaccagactcttttattttaacccccataagctggatcttctagcactttagttaaaaaaaatttcagttccagccctcctactttgatttctgttgaaaaacactcttttacctctgcttcttatacctaaaaatgaaaaagtcctgatttcttagccagatagcatttgttatacccatatatttctttaaacattcctgtttttgatggtggtaaacaagttcagttgtttgtcagtcttttttcacacagataggcaaatatttattttaacatctcttctttgactggctcagttgggttgtcccctggtaaactgctgaaacatattatttgtggcaactctatttaacagtagcatgcagtaccttccgtatgtctggtgatgtttaatttggcctaaaaattagtatatttgtgtctagtatagaaatcaaggttttatttttaaaggcttcttataactattttaagtattcccttctttcatgctcacttatgctaccaaaatatttttctttcaacattcatttaaatcattcaaaattaaactggtacttccacttagagattaagtaaaaacaaaaggggatcatagagttaaaaactaagctttaaattaatcacagaaaacatttatagtacggagatcttcgcccgtttactggtgcatttcaagaattatttttgtgcatcctggagatactagaagcagtttcccacagtaatatttttatttactctttcagtttacctctaatctaaactataattactgtcaaagagctttagaactgaggagcacagtgtgatcagtgctttttggtaaatgtagaagtttcattctcttatagttttagaatcttcttctgcagtgctaattcttaatagttgtgaatctacatttcagcatgtagtctccagataacttcttcaaatggctctccttttttaaatgtttattgcaactttgcagtatgtttagcttagatttaggagtgcaaagggttaaaggggtcttgttttatcaaggaaatagctgtattaagctgttttcagtttttggattataaaataccataattctgacatggtgtatttagtcttactaatactcaactttatttgggcggtagatactggtagaggcagttcaatataattgaatgttgaggtatgggtttgcttttttgttttgttttcaggagaaagatttgcccattttgctcacatcctacttcagatatgtgtcacagagccaaaatttgtttaactaattagctatttagttggaattcacagcatagtggaaaatgtttgcagataattctgtgcaatagtggaaacttcagttgcttcctcgtatttcttcagggcagtgatcacaaccagattcaacgtatgcacaaagcagcggataccatggtagcggccgtcgctgattgcttttaccatgttggatccattgtcagtctcaaagacctacttccagctaggtgccttgaactcaaatagcttttcacacagacttcaggatgtgagctaaggtatggccttttttcatgagctgggcctacatatgggttgacagtaacctgcaacttttatagaaaagagactactggctatagtttaatgtcagacaatgactagttagaatcattgataggcaggtagtgtgtgttcttcatatattcaaagtattctcaccatttagagattttctttttttcggtgtgtttttgtcagactattcaagtaaagatttctcattagaacctggtcaaaggtctaatatatatctgctttatgattcaaccattgtcttcaatatgaaatatatatcatttctttcacacatttgatgtaaagaatttttttaaacttctgaggattcttgcacaattatttttcttttactttttcttaattatggtaaaaaaataaaatttatcatcctaaccttgtgtactattttaataatctcttactaatcttctttttaaaagtggatttaggaaattggcatgaatagagcttgagatttagaatcagtagttccaagggtaatctacacactggggtggtaaatacaataaagacctaaactggattgatgcagttcatgctccatgctaaagattcttgtttcatcaaagagaaaataacctttctggaaaaagagcttcactttcatatcttccttctctgcaagatatgtttctttaagtgaaatctttattgagagtacagtgggttaactcattgattataggcttaggaaactatattttattatggctgtaatcataactgctttctgaaacaagttactgttgttttcttattcagtggccctgttacttaataatttgtcaagacctggtaatagagaatcatttacaactggggagtaagagtctttgtaaattcaaagtgggtactgtcaagcagcttatgcacttctcttcattctcagtgtttgacactgattgttattagctattgacaaatgcagaagttggtaatctgtttgagttactctaccagaatcatgtctttattaagaagtgactcactgttaaactacagtctcaccttaatttcatagctgtaaaagacacagtatagtagttgactcgagcagtaaaattctctgatatttcagtcttcagacgtacactatactctccttatatatgcaaaaacatatattcagatacatgtacatagacgacagttgatgactgaaatggtgtacagtataacatctgccaagtcatttcctgagtggtaaaggaaagtggccatgtgttctctgacttcttataactcagggaagataagaagagagcacaggaaaaaaggcagccattcagtgacatattatacctcttcagttaagtcaggtgacataagtttttaccttctagttaaagatatctgtagaaactagtttttgtttacacattgtaggaaccaaattcaaaacacatgcatgatactattttcatttattcttcctacccacttgagtggcttctgagtttactgtttatctaccttgagttaaggattgaatagcttctgagcagatttttgtttttgtgacaaggaaaggttcatttgtatgtagatgacatagtattatttgttaaggattctttttttttttttctgggagatggggtttcactcttgttgcccaggctggagtgtaatgacgtgatctcggctcactgcaacctccgcctcccaggttcaagtgattctcctgcctcagcctccccagtagctgggattacaggcatgcgccaccatgtccagctaattttgcatttttagtagagatggggtttctccatgttgttcagggtggtctcgaactcccaacctcaggtgttccacccgcctcagcctcccaaagtgctgggattacaggcatgagccaccatgcccagcctatttgttaaggattcttctactgtctgttactctttttatagttctctaaggctccatgaccactttgcgagatagtattttaatgtaatgaccaagtccctttttaggtaggtatacaactaaaaaaataagtgatgtatagtttagatcataccttagcataaatattttaaacacttttatttatatacgattttagtttgtttcaaatgatctatttaaagaattataaagatgtagatttttgaaattctaagcagtagtgtaaagatgtttgtgatgtcaataatgtgctgagagttggaatagagaaaaggaaataatgtttagttgtgttttcagtgactcttgtattaaactactagtacatttatctagaaaatttaaataaaaatgtaatgtcctatatacttaaaccttgctgtaatacatcctattgtgataacaatgtgaaatgaaattgggtacattttagatcctgataggaaataacagaataatatctttaaaatgaatatgccctaaaacttagtgtctcattaaaagatccaatgtatagaaacacattgtattaagacacccagtaatgaacctacattttactctaaaatatgtttttttttcttggaaatttaattctgagtgaaatacaaatagtattaaaatttaaaaactgcttgtggtcctttaattctcaaatattttaggtgtagaagtgatttctgtctctgaatatttataattatgtgtgtttttaaaagtgtgtctctgaggacatcaggtatctggatcttttacagtatgacatttatataatgtctgtctcttctctgattttatattagaagggaaaacctacccataactttactagccagtggcttcaaaagcaagttaatatagatcatgtgtgtgacaaatgaaatgcacacactcatttgtatattgatttatggaggtgttttagtcctaaaatcttaattttccttgcttttctttccatattaaaaaaattcagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcagggtacaaaacttttcctattatgccacttttcatttgatgtaaagatgtttcatttacttactgaaacctgcctttgtgtttttgctttatgttaatgattttaaagcaagttcatttacctaaaaattttgttctctgttagattttgttctttatctgatttcaatcatgtatagtctaatttttaaacatttctactatatatgattgctaaatttagtaggctgagaacatacattataaatatttcttccccctgaaattcatgaaattgaaaaaatgcctttatattagatagaaaatagtacattaagactatgggtgagaatttagtttaaattgatatctctggctggcgcagtgactcacgcctttaacccccccagcactttgggaggactaaatggatagatcacttgagctcaggagttcaagatcagcttgggcaacatggtgaaaccccgtctctacgaaatacaggaaacattaggtgggcataatggcgtgtgcctgtggtcccggctacctggaaggctgaagtgggagaattacctgagcctgggaagttgaggttgcaattagctgtaattgcaccactgtactccaagcctgggagacagagtaatactctgtttccagatagatggatggatggatggatggatggatggacggatggatagatattttcctatgttagctgaagaaagtgatctgaattatctattgtttcacttcctcttttcataaagatgattatgtttttgctttattgttatgtttatgttattgttatgtttatgaaatagaaattttttattctcagagcggttgtaataagataattgtgaagaagttgacaattttttggaattcacaatttgaactctagaggtgaattctttttagttttattttttaaaatatatacttaaaatgtatatgttatttatcttgaaatattaaataacagaaaaaaaactgggtgaatactccaagaaggcggctatgaaacccaaacctttgtcagtattaaagtcacttgaagaaaaatatgtggctgttatgaagaaattacagtttggtaagatgaaatttttgatttgcttaagatctcactttccatttttttttaacagtgctattgaaatgtgttttagcaaattaaagatttttaaaattgcttgtaacatgaattttacttcatacatatcaacattttttatcatctttgcctcttgaatttatgtctgtatttttagttataaactgtgacttcaatagaaggactgtaagagcctagaaaaaataaatccaagccaagtgtctacaaaacaggcagaaaatgtttttccttatttacctcttcatttctgtacatcctggcctgaaggaagccaagacccagaactttgaactaagtctgttactcttgccattttagatttccttgcaattcacctttagaaaatgtagttatacatagttcagttctagcttttcccattccaaaactcttgacaagtaagaactggcaaaaagattatatcagtaccctttatatggttctgatttatgagaaaacacataccaaattttgatgaccattattaactattattgtctatgctgctttttcatccttgagaaacaacctaaaaatcttggactgtatttttttaaatgctaaagtaggattcagaaaacagatttttgtcatattgtctttgaaacctcattataaatcatttagcttttgctctacttactttcaggtttgccataaagagcacaagagataatatatatgaaagtgatttatacttttgttaagagttttggtcagtgtctaatgatattacagccttttgcctgactcagcttggcaatctagtctgttaacttcactctaagtaataatattaacttggtttttaaataataaatattttattgaatttattattttattgaaaattcctttgtgtattaaagtactaaaaccaaatactttatttcatttatatgaatttaattagcaattaccaaggttttttatggcttattttatcaaatagttctatattatatattgtcacataaattacccctgtaacttatttgctttaaaaaactgacctggccgggcatggtggctcacgcctgtaatccagcactttaggaggccgaggtgggcggtcacgaggtcgggagtttgagaccagcatggccaacatggtgtaactccatctctattaaaaatacaaaaattagctgggcatggtggcaggcgcctgtaaccccagctactcaggaagctgaggcaggagaatcatttgaacccgggaggtggaggttgcagtgagctgagacactccagtctgggcgacagagcaagtctccatctcaaaaaaaaaaaaaaaaaaaaatcatgacctttattatctcactctttacatgggtcaggaattcagaaaaagccatagtgcctgttatgaccttgtcttagaaagtgtacagcatcactcactaagtccagccaacactcaaggggaggggaagagtgtcagaaaagagtttccagacatatgtttgtgtatgtgtgtttctgttggacataaatattttattgggctttagatttcgttccgcttcctgggtcatcaaaaatatgtcagctaatggcttttaaaaatacatggcagtgttcttgtacttgaaggcgtttagtcatatttcatatctacaaattctttaactagttctttcaatccagaaagtcatttcatgtatatgaatgtgtttatggatccttatgtgtgagagattctggtttaaagttactacctgtcagaaatttagaatcatatgtccagaccccttcattaatgttagctagctagaagagttctctcatactacataaaatcataaactctccaagtatgtgactttaaacataatcaagtttgctccccattggctttcaaaataagtctgaaaacatgcaagttttcagttgatgctttcataagaaactgcattttcaaccatatgtatcaaacattttctagtatcattcttttacaacttgatacttactaactgcctaaaattccataatatgattggctgccatttgtttaaccagtaagtggaactttagtttgtttccagtatttaaatatcatatgcaacatctcagtggctttcattacctgtaaatatttgtgcatatccaggattaattctgtaggatgaattaacagaagagaaatgattgattaaaacaggctgtgcatgttttatcaagtagccattgtctttgattgaatcatttatttaatgaaatctttgagttaatagaccctgtcctctatatgatataaaattttcccactgggcatagtaatgggcccatttcttgcatctgttagattgttttttataaaagttaaagaaaatgtatccctatagcatgtgaaagacaagagtccatccatctggcagtgctaatccatctggcagtgctaatatataggtgttatgtaaacatttacacttttgctattcttccatggttggaagttctctccagttgagtgggagaaggactagtgattgtttgtgatttttgtcattataacaattttttgcagttctgggttttattttttcttctccttttagatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggtaaaaaataatgataataaagcactctcccttatctccttggctcatctaattactcaaatttttatacaaaactggaaatactatacaaataaattatacaaaacactagaaattttggtgaccatttttagacggcagtgaaaggagcctccccacccctcccccccttttttttttggcgacaggatctcacttttgcccaagctggagtacagtgatgtgatcacagctcactgcagcctccacaaagagcccttttctaatgttagttcagagtgtgtggatcacgctgctgttgaaaaaaacatttagaaaatatcaaaagagccatcatccttgagcaaagattgtgtgaagctggtcacaatatcaaaggatttaatgctgatcagttaaaaaatgttacaggatttccattttgtcatccaagatacttctctcatgttttttagtgtcactcttcaaaacttagtcattttctgtcttttctaggaaatttatgttttttttaaattcctaacatctgtgaattataggtaatacaataatatataatctctacttttatgtttaacacgtgataatctggccttaaattccaagagtctgctgcatcaagaaaatgttaaacatttaacccgaaaaagaaaactttctttatatttatgatttaattcatgggttaaacattctgtcttccatagatacgcagctaaaactattggcccattgacttgtagaaagttttatttgtttgcttgcttcttttgattttttggataggctcatgcctgtaatcccagcactttgggaggctgaggtaggcagatcacttgaggtcaagagttccagaccagcctggccaacatggtgaaaccccgtctctactaaaaatacaaaaattggctggctgtggtggcaggcacctataatcccagtacttggcaggctgtgtctggggaattgcttgaacctggaaggtggaggttgcagtgagctgagatctcgccactgcactgcagcctgggcggtggagtgaaactccatctcaaaaaaaaaaaaaaaaaaaaaaaaaggcctggtatgctggctcatgcctgtaatcctggcattttgggaggccaaggtaggcagatcagttgagatcaggagttcaagaacagcctggctgatgtggtgaaacctcatctctactaaaaatacaaaaattagccaggcatggtggtgcatgcctgtaatctcagctactcgggaggctgaggcaggagaatttcttgaacccaggaagtggaggttgcaatgagccgagatcacaccattggactccagcctgggccaccaagtgagactgtcttaaaaaaaaaaaaaaaaagctgttcttattttggccaggcacagtggctcaagcccgtaatcccagtgcttagggaggcctatgcaagcggatcacttgaggctaggagtttgagaccagcctggacaacatggggaactggtctctactaaaaatacaaaaattaaccgggcatgttggcaggcacgtgtgttcccagctattcaggaggctgaggcaggagaattgcttgaactcaggaagcggaggttgcagtgagccgagattgcgccactgcactccagcctgggcgacagagtgggactccatctccaaaaacgaaggttgttcttatttcatgttggattgtatttttctaaatatcagtgtttaggaatgttaacatagacttttgtatgtttatatatatccaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtaaattaattgcaattttttgtttcaaatgccaatgattgtatacaaaggttctttgtaatttgaagaaaaattttgttttagttatctgctaagagggcatgggtttctttgtacttctcttccctacgtccagattagcttaagcaatagaaggaactgaaaagagcagaaacagttaagtgttaattaagaagcacttacagtcttaagaagttactcggggacttaacgtaaagttctatgatacatgctattaggaacttattttaaggtgtaccttatattcaagtgtttttacattttcttatattaaaagtaggaagatgcatttccatttacaaaaaagctgaccaaaagacataataaaaatcatctcatatgaccataaaccttttaaaattagatttaaaagagtaatctgtttttcagaggtattttggatactttgatagaatttcaatggtaaattctgtgctgagtattcaatgttttaaaatctagaagagaagaatttcaaaaggtacagcctgcctcagatatgtggcagatatgtggttgcaaattatcattagctcaaatcataaaactagaattagttttttgggtttgttgcaaaagatttgaccagaggcagaactttctttggaagaacaaagaacaggttttctgtagctgagtagggaagaggaaatagcaacattgactttacttgagacactggaacttgaatagagtgtaagtgtaaaatattaagatgtatttaagaaaataattctcaaggcttcgttgcatagagaagagggtaagggcttgggaatcttaaattaatggtcttttaccatcatacttaccgatgtgttccttgatacacacaattgtggacttatttttaaagtttacacactgttagcatttaatcttaggtcctatatctacagataggtatgaggctacatatctgccattgttagtcccaagaatgctctaaagcagggctgtccaatgttttggcttccctgggccactttggaagaagaataattgtcttgggccacacaaaaattcgctaacacaaacaatatagctaatgaactttaaagaaaaatagcaaaaaaatctcataatatttttaaaaactttacgattttgttttgggctgcattcaaagccatcctgggccgcatgtggcctgcgggttgcacaagcttgcactaaaggtcaaatggtatatgtatgacagcactttgaataatacacaagacttcacagatacaactcattaaattattaatcaactacctgttgaatgaattaacgtattttgcgttcttgctttcacagagcattgaaagagtagtaaggagacagacctttctgcatttacgagaaccacctacgccgggcgtggtggctcatgcctataatcccagcactttgggaggctgaggcgggtggatcacctgaggtcgggagttttagaccagcctgaccaacatggagaaaccccgtctctactaaaaatacaaaattagctgggcgtggtggcacatgcctgtaatcccagctacttgggaggctgaggcaggagaagtgcttgaacccgggaggcggaggttgcggtgagcccagattgtgccattgcactccagcctgggctacaggagcgaaattctgtctaaaaaaaaaaagaaccacctattatccaaatctgttggccattatataaaattattaaattattaaaagtgtacaaaatctgatgagtatattttatgttgatagaatatatgccagaagaacacatgtgattggcccagttttgtttttattacaagagtagttacaggtgcagattaagtgtccccagttctcttcctgctaagtgagtaagtatctaatgttatctttaagtatattttgaggaaccctgggaagcctgaatactcttttagggggtctgtttgcgtgaggctagatttgatccatatacttgaatcaaaggagtatattgcaactagttgaatgtagaggcagataattaaatcaaggtctcttctgttaagctattttgcattttcagaatttagaaagaaatacacaaaaatataaaatagtaccacttttattaaaaatagttattttagtaaaaatagaactagcatatgatctatcagtcccactattgaatatatatccaagggaaataaatcagaatctcgaagagatatttgcactgctgtttattgcagcaccatacagaatagccaagatacagaatcaacttagcggccatcaacaggtgaatggataaagaaaacttggttatacacagtggaatactattcagccatgagaaggatgagatcctttctttcatagcaacatagatgagcctggtgggacattatgttaagtgaaatacatcaaacattggaagataaatattgcatgttctcactcacgtagaagctaaaaaaattgatctcaatcaacgtagagagtagaatagtggtactaaagctgggagggaaaggtagagaggagggaatagggagaggttggttaatggatacacaattacaactagataggaggaataggttctgttgttgtatagcacagtagggtgactgtagtaaataaaaattgtattttgtcaaacagctagaagagaggatgttgaatgttaccaacactcaaaggtttgaggcggtggatacaataattaccctattttgatcattacacattgtatacacatattgaaataccacactataccccataaatatgtacaactatgtgctaattaaaaatgttttgctttttaaataatttagttttcattaaaatgttatttgtgttgacatataataggtgctggtctgttttgcattatgaaaaagttataatgcctcacaaatttgaatcacatctgaagatgccaatttgttttaacagacaacccttagggttttatctaggggacatataaaactgagatattttgacaggatagcattttgtttttacttctcgttatgacagtttgtttttaagcactcttttttcaattctgtttatgcttttttcgttcgtcaggtttgtttaagcatcttaaacacgtggcatggaagaccagaagagaagtggaatcctcagacctcaagctttttgcaagtaaacaaaatttctctgacattttcacttaagaaataaagaactgtgtagtattttaaaaaatttttagtgaccaagaataaatatagtaaacctaaaaaaagatagattactaggaaatgcatattaaatagcttataggtgagaagttagcataatggagtctcatcttatgtgtaatctaaaatctcaagttggggcataaaacaaaaattgagtttagccaaaactcccatcaaaaaaaattccaggccaggcgcagtgcccaccgttacctgtgtttcttgatttctgttcctgaacagattatgagagcctcttacagttgtgcagatgctaacatgaagctgaaaaggagagggggcacaggtgtgttggcacagcactttgggaggctgagatgggtggatcatttgaggtcaggagttcgagaccagcttggccaacgtggtaagacccgcatctctactaaaaatacaaaatacaattagccggacgaggtggtgcgtgcctataatcccagctactaggaggcgcctctgaggtaggagaatcgctggaaccccggaggaggagattgcagtgagccgagatcacggcactacactctagcctgggtgacagagggagactctatctaaaaaataaaaatcaataaataaaaacgaaagggacagtaaatttggcctgtgaataaaagtctttactctgaaaatatcaacaaattgactcaaatcatgagcctacattatggattaaaaataaatatttattattacatcaatataaatatatgtatatatatatcatatatactgtatgtttttatgttaattaccaattgatttttaactcagattctaagaaaacactttagcttggtataagtaaaataaatactactttttggtttgatccaaatagctttttaagtgacgttctgttgatcagacagttcatgctggctgcttttttgcatgcctctaatatatttatagaaattatttttagtgtagaattgattttgttctatattataaagttatgtaattctctcattcatcctgtaacacaagtagatcttatgccccttttacagatgatgaaaatataggttctaaatgtacagataactttactgtgatccctatgacttcaaatattgtacactgtttctcaggcctaaagttttattttataatactgaaaatcagatttttttaaaagaggaaatccttcatgccaagggtttactgtttctctgcttatttccggcctacagtaaaatgtagtgtgcattaaaatgactgtgtccagttcagacaatccagtggtccagaaattccctaaaatatgtattatagctattaaatagctaagttcactattgaaaaataaagtggcatttatactcttccaaaaaggtaatgtctgctgggccacccagtggtaagataacccatgtcataaagtattttttgaatttaattgcaggaagtattgatctctgataatcttttgttgttattcttatcaaatacaaactttatatttttctctcagcagacaataaattatagccacatttatttctcagatgtaattttttgttccttttttctggtacacaaaacactcattcttttttgtttaacttttatgttaggttcaggggttccactgcaggtttgttatataggtaaactcacgtcacaagggtttgctatacagattattttgtcactctggtactaagcgtagtatgcaatagttatttttttcttttttcttttttctttttcttttcttttcttttttttttttttgagacagggtctcactctgtggcccaggctgggcacaaccttggcttactacaacctctgcgtctcgggttcaagctgtgtttccaccttagcctcctgagtagctgagatcacagacatgcaccaccacacccggctaatttttgtatttttagtagagacagggtttcaccatgttgaccaggatggcctcgagcccctgatctcaagtgatctgtctgcctcagcctcccaaagtgttaggattacaggcgttagccaacgtgcccagccagtagttatttttttctgatcttttccctcctcccacgtttcaccatcaaataggccccagcgtctgcaaaatattttatgcttcctttagtgggctttgctttgctgttttaaacaaaatacgccgtgaatctaaagtaatttttaaattgttataactgactgagatctataaaaccatattgtgtctcaaaggagatgaggttaaataaataaaagagtccttttttataaatttgtaatgaatatttaatttctttctgtgcttttgtacaaaaatgcaattataccctacttatattaacagaagaggacaattatttaagagggaagaggacagtaactaataactatgcctttgaaacttacctcagaagtgtcagtaaatgtgagatgtctggccgggcgaggtgactcttgcctgtaatttcagcactttgggaggcaggcagatcacttgaggcctggagttcaagaacagactggccaatatggagataccccatctctactaaaaatacaaaaattagcgggatggggtcacgggcacctgtaaccccagctacttgggaggctgaggcagaagaattgcttgaacccgggaggcagaggttgcagtgagctgagatcgcaccactgcactccagcctgggcaacagagcaagacactgtctcaaaaaaataaataaataaaaattaaaaatatgagatctttatctcagaaataatatgaattaaagtttttcccatagttgagcttggcatcagtatggtcactttctattttgggtcaaatacgttactttcgagtactcatttttaaagttctctttaactttgacttataagatgcatatccatgggactgtttaatcgttgtgcccaacaaaagtgtaattgctgttctttttcatttatgaattgcgtagataatatctgatgttttcctgccttcaaagatgttactttattgacttctatagatacattaactggaagtactgtattcgctagaaatcacctctcttaatatatgttacatctgggacaagccttctagtaaataagtggtggtttggaagtggtcttagaccataagaccatcttgtcaatcagaatttctggccgggtatgatggctcagacctgtaatctcagcactttgggaggccaaggtgggcagatcacctgaggtcagaagttcgagaccagcctggccaacatggcaaaaccccgtctctactaaaaattaaaaaaaaaaattagccctgcttggtgatgcacgcctatagtcctagctacttgagaggctgaggaaggagaatcacttggacccaggagacggaggttgcaatgaaccaagattgtaccattgcactgcagcctgggcaacagagcaagactccatctcaaagaaataaataagaatttctaataaggtttttgtgatactgtagcagttaattgtccttggaataaaaatttaaaatggtctcaggcatagtttttttataagtgagtattgttaagagtgcatggctaggccaggcacagtggctgacgcctgtaatcccagcactttgggaggccgaggcaggcagatcacctgaagtcaggagttcaaaaccagcctggccaacatgatgaaaccccatctctactaaaaaatacagaaattagtctggcgtggtggcaggcatctgtaatcccagattctcgggaggctgagacaggagaatcgcttgaatctgggaggcggaggttgcagggagccaagatcatgccattgcactccagcctgggtgacaagagtgaaactcagtcttattaaaaaaaaaaaaaaaatagtacatggctagttttatgctccttaagaacagtttgagcagaatgttgctatgagttgtttaaactcataaaacaactaaaaaaaaaataaactaaactaaaaaaacgaaatttttttagcattttttggaaatagattcttcatatctattattattattatcatctatcttcatatctattattattcaagaattcaagagtaaaaacagatgtgtaagtattacttatggctctattgtgcctaattttattttgcctttataatgaaatatttcaatgttataatcataaacattgattttattgtgatagaaatttgtggaaacacatattaaagaagagtctttgtggataaagcaggatatcagttaacccacagtaaaaatgtcccatcatagctgttcttttcctttattctttaggtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtatgttcaataaaattagtgaaatactttgttaaagacattttacaatataggctgggcatggtggctcatgcctgtaatctcagcactttgggaggtcaaggcaggtggatcacttcaggtcaggagtctgagaccagcctggccaatatggcgaaaccgcatttctacttaaaaaaagaaaaagataaattagccaggcatggtggcaggcgcctgtaatctcagctacttggaacgtgaggttgaacctgggaggcggaagttgcagagagctgagactgcaccactgcactccagcctgggtgacagcagagcaagactccatctccaaaaaaaaaaaaaaaaaaaaaaaaagacattttaaaatatagtttgttagtattctatttgcctttatatgtatctagtatatgaaactgcaggttttagagttaatcccaaagatcattaataagtctggacaatatagcaagaccccatctctgcaaaaagtttaaaaatttagctgggcatggtggcacctgtagtcttagatactcagtgggctaaggcaggaggtttgcctgagcccacgagtttgaggctgcagtaagctgtgttcacatgactgcactccagcctaggtgacagagtctcagaaaaaaaaaaaatggtagtagatagtacagatgaagtataaaactatctatattctaaaagacatctgactaaatttttgagaagtttttttcctttcctttccttttcctctcctctccctctgctctcctttcctttcctcctgtcccatcccgtttcgttctcgttgcccaggctggagtgcaatggcatgatcttggctcactgcaacctccacctcccaagttcaagctattctcctgcctcagcctcccaagtagctgggattacgggcatgtggcaccacgcctggctaatttttttgtatttttagtagagacggggtttcaccatgttggccaggctgatcttgaactcctgacctcaggtgatccacctgccttggcctcccaaagtgctgggattacaagcgtgagccaccgccccggcctattctttatttttattagttacccttctactagcaaactctctaaatatgtttctgatatatttctcattgaactgttttttattgaagatggtttctaaagttgtcttgcaaatagaaattttgcccttattctaatgtgtatatataaggagaatgccatttcttttttttatttttttgagataggacttggctctgttgcctgtgctggaatacagtggcggaatctcggcttactgcaccctccgcctccccggttcaagtgattctcatgcctcagcctcccgagtagctgggactgtgtgcgcataccaccgcaactggctaattttttttgtattttttagtagaggccagttttcaccatgttggccaggctggtctcgaatgcctgacctcaggtgatccgcccgcctcggccttccagactgttggaattacaggcgtgagccactgcgcctggccacgtttccttttctttaggaaaaaaattggatgatatgagtttccaaaacctgtattaatacactgaagtggtttttttcacgtcatcctgaagtgtggctctgtgtgtgtgtgtgtgtgtgtgtgtgtagctttttgcctgtgattagttgtctctccatagtatacctaaatagaattatacttttcacctgccatatcaaatgacgttagcatcacaacttgctgtgattgtgtccagaaacatttttctttcttaaaattgtttcacttgatcattaatttcttaaattgtgctggaaagttaacattttagaggaaaaaatggtatatttacctgatataaaattgatctttaatataactatgcagatgttctacatgaatactatgaagccacctccttcatcagatagcactgatgaatatttctttttctttggcttttgctgttactgagtaaatttatattccagtgtcctttgaatgacaaagttggatactttacttttgcaaagatcgcgccacggcactccagcctgggcagcacggtgagactctgtctcaaaaaaaaaaaaaaaaaagtaatttgttttatgcatatcatttttttcaggaaggataaacacagggaactcagagaaggggatgacttttacaaaaagcaaatatgtataatttgagacaatcaactttctcattctttagaacctagcttgcgttaaaggggccactccttggccatgtatgctttcccagttttcctaatcaaatgccactcgctactctttgaatgccctgggctttttgcttttgtttattgttgttctttaaaatatatttttttggtacactcccgtcccatctgattctgttgttaccactgttcttcatttaaagctgtgtcatacttacttctgtatcccagaggcttcaaacccaataactattaaatgtggtgggatcgtattggtgtttgacattcattcccagagctttctagtgattttccctttataggtttgattgtctgttctttagggcagacatgctccctgggcaatgctcaaccagaatacagagcaatgtttccaaattgataattgttttctaatttaaatttgtcagaaatagactcttactactatatgttggtagaaattttactcagtttttcaaagatagaattgaaagatagaatttaaaaatcgcaaatgtaaatcacagtaataataaggaaatttaacttcctaaaataaaatcccatctataaattaaacagaagataaaattaagcaagtaagaatagtgccatttctggggatttctgtgtgaatgcctttggcatttagaatatacttatctaggtgttctttgagttatcttttaaaggcagaaatttctctgttgtcaatactttttaaatcttttcgcctggttacttatttagcatttgccttctgagtatattgtatcatatgtgtcttgtggtctctggacaggattaattttccaagtgtctgaccacaattgtacactcttttctgctataaatttgttttctcttttctctcctcccctcctctcttcttttcttttctttttgatggagtcttgctctgtcgcccaggctggagtgcagtggcgggatctcagttcactgcaacctctgcctcctgggttcaagcaattgtcctgcctcagcctcccaagtagctggcactacaggtgcctgccaccatgcctggctaatttttgtatttttagttctgaccttgtgattcgcctgccttgatctcccagaatgctgggattacaggcgtgagccaccacaccgggccataaatttcatatatttcaacacgtcatatcaaatcatgagcttgatttttccctgctaatattgtagagttgattaaattgcctttttttttttgtttgagatggaggcttgctctgtcgcccaggctggagtgcagtggcgcgaccttggctcactgcaagctccacctcccgggttcacgccattctcttgcctcagcctcccaaattgagttttatggatagaaaaacattgcagtgtctgtatatttatttcattaaatgtatttataataatattctaaatattaatttaaatgtatttatagaataaattatttaaatgtatttataatacattttacttctttgtaatgtcatttactgtgtcttttaaatttgactgtaaacactgcttgttctcctgtttactttttctcaaggtaatacacaaacatttttacttgaaaagagttgagataatggcccaatgtgaggagtggattgcggatatccagcagtacagcagtgataagcgggtaggcaggactatgtctcaccatgcagcagctctcaaggtgagtaagcctctctaacaggagccttgttgctttaagagttgtgtaattattgacagaaccatgcctaccagaagataatgggagggagggaattaaagaaacataatatgtattttcagttcagaggaataaattgttactcagaagtctatagaaaagatacatttttttttggtagtagattgacagttcctaaaataaaaagtgggtccaaggactgagacaacagagttttgtaaagttccttgaagataatgatgacaagatgtgctccatgaatgccttttcctttttctttttttcttttgagactggatttcattctgttgtcccagcctagagtgcagtggtggcatcatgactctctgtaaccttgaactcctgggctcaagcagtcctcccacctcagcttcccatgtagctaggactacaggtagctgccacagtgcccagttaaatttttttattttcaattttgtagagatggggtctcaccctgtttcctaggctaggctcaagtgatcctcccacctcagccacccaaatcactggaattataggcatgagcaaccgtgccagacttgaaggacttcttttattcccttagtctttccctaggcctcctgccttccagaattttattacttggagtgatgagggagatttgagttgcagattctccctcagctgatggtggcagtggctgtgttaggggagaaagcagttgttttcagtttggacgttcatagaatggaaatgtgaaatgtgattggtttggaagattttctgtctacccacggagatctttctttgtaacagccttccttttttcctgcatctgaatgtctttactcatttcatcctccaccaatatcctcccttttctatcttcaggtttttccatttctactggcttgttatcttctaactttaaagctgtcttcacttcaaacaactagttgatgataaggatttgttagttttttaggtgtgatttttaaaaagatccctatcttttcaggacatgtacagaaatatttgtgaatgacaaagtgtatgatgtctgggaattacttcaaaataaaatgacaaggggaaagtgtgggaatatagatgaaagaagatgggccatgagttgataatggttgaagctgtgtgatagattcatgggacttcattgtactcttctgcccacttctgcatatgtttgaattttttcactataaaaatgttttgaaaaagagagaaaaacacttgcagaaaatttccctaagctagttctattttgcccctattattatgaaacagattgtcttctttcaccgtcagactatagcagttgacacttcttgcctccattttttaacctttgtctcactaatcaaccttatgcagtttgacttctattttaccaaagttaccatctctccagttctcaacgccagtgaccctggctcacttctccattcacttcatctgctctccctcctccaggcctttacacatggtttccattttcctctacttttcagctcttctgcttgctcacctccattcatatttcagcttaaatttcacttcatggaaccctgccttgactggtttgtttgtttgtttgtttgtttgtttctgagacactgtctctctctgccactcaggcatgatcttggctcactgcatcttccgcctcccttgttcaagtgatttatctgcctcagcctcctgagtagctgggattacaggcatctgccaccagacctggctaacttttgtatttttattttcattatttattttatttatttatttattttagatgtaatcttgctctgttgctcagcctggagtgcagtggcttgatctcagctcactgcagccttaacctcctgggttcaagctattctcctgcctcagcctcctgagtatctgggattacagtcacctgccatcatgcccagctaatttttgcatttttagtagagacggggtttcaccatgttggccaggctggtctcgaactccaggctggtcttgaactcctgacctcaagtgagccaccgcgccccgcctgactgatagactattagatcatttcagtataagcatttctaaccctctgcgtctacctgttaaaacactcataacatttgtctaatgtttgtcttttgtactatacttttcatctgtagactatcttggcttttctgcttatactcttcttaattctttcagtgtgttttcctttttcttttttcctgagcaattgtttacctgaaggcttactttttggccttcagaactattttttttctgtctttctgtttttccttcattgtgtctgtaaccctgactttggccatttactctctaaaagtgacacttcaaactgttgtcagctgttagctttctcttgagttgtattactgacattttttacatagataccctgtcatcatctccttaaaggagattttcctcaaatcaagttttctagctttctatttacttaattttacttgattttaaaccatttttctctgtcttagaatcttcaagtattatgtatctcatccttcatccagcacccctggtcagtactaggtcctgtcagtattacttcatgaggggactgtcctctccccaacccatgatttctgttgagttcccacagctttgtctgtttgtccagcttccttgtaccaggttctccccctttcagttccttctttagtgcattaccaggctgatcttccccaaatatgtatttagatatgtttttcacttacacaaaactggctcaagtccagcttcttttcattcagtgtcttgcttatatccgcattcctttatttcttctgtgtcactgtcacctggaattttccatctctgaattaatccaaatttatatcattttaactgtacatttgctgttgagtgctacacaagaaaaatacacaattggccaggcgcagtgactcacgcctataatcccaacactttgggaggccaaggcgggcagatcacttgtggtcaggagttcaagaccagcctggccaacatggtgaaaccccaactctattaaaagaaaatacaaaaattagtcaagtgtggtggctcatgcctgtagtcccagctgctggggaggctgaggcaggaaaatcgcctgaacccgggaggtggaggttgcagtgagctgagattgcgccattgctctccagcctgggcaacgagtgtaaaattctgtcttaaaaaataaatgaaaagtatgtagttgtttagcttgactccacaataaaatcatagtatccctgtattaggctgttctttctttgctataaagaaatccttgagactgggtaatttataacaaaaagacattcaatgggcccatggttctgtaggctgtacaggaagcatggaactggcatttactctgcttctgtagaggcctcaaggaccttatactcatggtggaagatgaagcggaatcacgaaggcgtaggggtgtgggaggtgccacactttacaacaacccgatctcgtgataattcactcactatctcaggacagcaccaatccatgaggaaactgtccccatgatccccatttctctcacctccaacacagggattacatttcaacatgagatttgggcagggacaaatatccaaactagatcaatccccaaccttaactcagttctcatgattgccagatttttctttctccttccctggttagtgatttcacctgttgtccacagtggaaggaaaatcaaggctagggaaattctcacttaccggcatgtaaatgtgctttgaaactttgcaaatagctgcaaggtagagttgttttttcctatttatgtgtcttataatttcagccagaattttagactccataagcttaaagattttatcctcattctactcattgcctttatgttgttggtatttaacacagtgcctcatacataaaaattgttctgtaaataaatgttgtttaattttcaaagtcagctgttgacactatttagtttttatttattttattttattttatttttgagatggagtctcgctctgctgccaggctggagtgcagtgctgtgcgatctcagctcactggaacctctgcctccctggttcaagcgatgctcctgcctcagcctcccaagtacctgggactacaggcacacaccaccacacccagctaatttttgtattttttgtagagacggggtttcaccatgttggccaggatggtctcgatcttttgacctcgtgatctgcccgccatggcctccgaaagtgctgggattacaggcgtgaggcatcagacccggccgacacaattttaaaagcctttggtgtgattatttaaggtcatttctctctcaccagaaaattatgaaccaaatctttgcatgtgttagacaaccagccactcccaattaacatgcctatatccttacgtaaactgcaatatagagcaaagcaaagtttatttaatctctatagatcttctttttaactcaattttgtaaaaagttctaatgataggctgggtgcagttctttgttcttctatgatctttttaacttaattttttaaaattctatgatcttctttttaacttaattttttaaaaagttctaatgataggctgggtgcagttctataggctgggtgaatctgggtacagattcacacctgtaatcccagcactttgggagtccaaggcaggtggattgcttgagattaggagttcgagaccagcctggccaagaaggcaaaaccccgtctctaccaaaaacacaaaaaaattaactgggcatggtggtgcatgcctgtaatagcagttgctcgggaggctgaggcatgagaattgcttgcgtctgggaggtggagtttgcagtgagccgagattgtgcctctgcactctagcctgggtgacacagtgagaccttgttctcaaaaaaaaaaaaaaaaaaaaaaaaattctaatgatacaattatttctaaggtttattctgagcattaagtgggaaaattagtgtgaacatttgcagacattttacatatggcctactacctgataaatatttttttcattcgctaaagtatcagtggatttattttaatttacggatttgtctttctctcaaaaacgtttagccagagtcagcatgtatgacaaatcaagggattacggtgtttaatttgaaagagtgtataggctgggcacagtggctcacacctgcaatcccagctctttgggaggccaaggcaggtggatcgcttggaccaggagtttgagaccagcttgggcaaaatggcgaaaccccatctgtgtaaaaaattagctaggcatggtgcttcattcctgtagtcccaactacttgggaggctgaggtgggaggattgcttaagcccaggaggttgaggctgcatgagctgtgattgtgccgctgctctccagcctggatgacaaagcagagctatcttaaaacaaaataagagaatatatgtatgtaggccgggtgcattggctcacgcctgtaatcccagcactttgggaggccgaggcaggtggatgacagtcaagagatcaagaccagcctggccaacatagtgaaaccccatctctactaaaaatacaaaaaattagctggttgtggtggcgcccacctgtactcccagctactcagaaggctgaggcagaagaatcacttgaacccgggaggcggaggttgcaatgagctgagatcgcgccagtgcactccagcctgggcaacagagcgagactccgtctcaaaaaaaaaagagtatatgtatctaataatgtcctttaaattgtcagtaatgctgtttctgtgacagcttggcagcatgggtaggatctactggtgggttactgaggtcttttcagcaacatcggttactttgaggttaaggattcttgtcagttttgcttacctactatatcaagtgcctgtaacagtagcttgcataaggaggggctcagtaaatatttgtaggcttaatgctttgggctttgttgaaattcagttcctgcctcaaatgatgttgtgctagagggtttgcagttctaacattagtccttttctcctgcatagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaacccctttgccatggtgtgaaatgctatttctataaagaattgaacactttcaagacttaagcatgggaaaacaaagcatgtttttccaagaccagttgccgcaggggaaaggctaaggtgattctttgacagtatttttataaaataaaagtggcggctgtgcgcggtggctcacgcctgtaatcccagcactttgggaggccaaggcaggcgggtctcctgatgtcaggagttcgagacaagcctggccaatgcgatgaaatcatgtctctataaaaatacaaaaattagccaggcatggtggtaggtgcctgtaatcccagctactcaggaggctgaggcaggaactggagctgacgcctgaatctggagctgaccaggagaagccgtattctgaaaggcgagttgctctctgatgaaaaaggggatcttggggaaatgatactctcttatgtacaaagtataaagctccttcagcatggaaaaaggagaaacgaatagtatttggacaggaaatcaaagattctaaaacacatagtgttaggtctggtgggtagtgagctacaccgaaaatgacaaaatagtggtagtttacaagaagaaaaaaattatgtcacccacagacatgccagctaaaatctaagtataaaattatcagcaataataaaggacagtcattaatcctttaggctattttttgttgtttttgtttgtttttggactgtgagtgctggatgataaaagctgtatcaaatgtattgtttgtcttccatgtaaaatgaaagtaacaataccagtactataaggtccagttcatattttttaaaaaccaaagtctaaacacctaaattggaaccaattacattaaaacattccatttgagatccagactttatgtcaacaaacatttgagcactcattttttactagttccaagttcctgcacttgaggagtgaatgacagacatgaaaacatgtcagtgccatctggtaaggtctctggtagagttatttacagggtaatattgggagcacagaggagaatccttatctcaggcaaaacgttgggtgggcactgaggtgataatggtctggaaaagctttctaagtgcagactaattcttgaaggatgaggataaagaagttagccaggcagaaacaagataatccagacacaggagagcaaaaggagagctcaggttgatggcaccatattggatgttactggatttttaacaggcaaagtgaggatagtcaaaagggatgggaggcagtggttttggaaagagaggaggggtcagttcatcccaggcctttgcttgccctgttaaggaactttgacttcctgtaggtaaaggagagctcacaagtagctctaaggaagtaacctgattagtctatttcaggaagatcattctgcaacctgttgagaagcgaggagatcagttaaaagcctgctcacatccaagcaataggtcataaactagggcacataaactgtggagattaagagacaattgacaggactttgggaaatacatatatttgttaggagaataactttagcatgttttcaggctagggagccaggggagaagtccttggggaaggatggagcaaagcctaacagacataaatgacctgggtccaagagcacatgcggagaacttgaagagatgtgaaaatcagtaaagtgaattggtctatttgtgaaacttttaactatataaagtttttatcttaatgaacagtaaaaaaacaaaaagtaaaactgcttaaatactttcctagcattaagacaaaaatctccaaagtcagacaaatgtaaaatgtactgtaggctgggcatgatggcccacacctgtaatcccagcactttgggaggctgaggcggaatgattgcttgaactcaggagtttgagaccagcctgggcaacatggcaaaaccccgtctctacaaaaaatagcaaaattagctgggcatggtggcacatgcctgtggtcccagctactcgggaggctgaggtgggaggattgcttgagcccaggacatggaggctgtagtgagcctagatcacgtgactgcactccactgtgggcaacagcaagaccgtgtcttaaaaagaaaattaatggatgtttttaacccatctcttactgttggacagtttggaattgcttttgtctctgcttttctgattataactaatgctgtgatgagcatggtcttatctttattttcttatgataaatcctagaagtagaattcctaggtcaaaggttttgatatataatgaccgctttcctgagaggtactgattcacacttggaaaatcttttagtgttgtcatgcgttggccagcattggagattatataattttttgatctgatattttattatcatcaaacatgttttaatgtgcattgaacattgtttatattacccatttgaatttctacttttgtcagttaccagtttataccttttccctattttgtgtattttcttagagtcttttagtatgtatcagctacttatagtagaatattagtttttgtcaaacttctgtgtatttgtccagatggccttttaatttttgtttaatttttctcatagaagttttaaattgtggggccggccgggtgcaatggctcactcctgtaatcccagcactttgggaggctgaggtgggtggatcatgaggtcaagagatcgataccatcctggccaacatggtgaaaccccatctctactaaaaacacaaaaattagctgggcgtggtggcaggcgcctgtagtcccagctacttgggaggctgaggcaggagatttgcttgaacccaggaggcagaggttgcagtgagcccagatcgcaccactgcactccagcctggtgacagagcgagactccgtctcaaaaaaaaaaaatttaaatcgtgaagtcatctattgatctgttcctttctgattttaattgcattttattcctttgaagttattccctatgcaaaggcaaaaaaaaggctatatattttctaactgagattgatttttggtattgttacaggcttcgctgcaactgaattgcaacaggcttgagctgcttcccatctcgcaccctgcagaggcaggtatggtggtgacaagccagagtccacatgtggatggaagatacaagccatgttgaaaggaagctccatcctgctttctctttcctcttcaaactctgcccagtttctagcagccatccaagcctcctttctctcagcttctagcctcctgatgcttcaagctctaaaggggctgacgtgaaccctgtgagcctatacatttcctgtatagaagaggcattctctggccttctttctcccttagttcctggatgtgatctcgtagtgctcccatgagctccaccaaaagtctgctttccattgcttccttcatgtgtgtccctcttcaggttgcactagctgttttcctgtgcaggaagagactgcagcccaccaccattttaattgttttcagttttattcacgtctcacttctccagggagggaatacccagtccaattatgtcagctgcaggctgccctgggccgctgggagacctacggcctcaggttagacacttctgcctgctggggtccccaggatactgcccctccccacctccctgtactcctctgggtcaaaaggtagacaggcatttccctcgttcttattcctaccacttctgttccttgctgttgctttcccccagcctttctataggttttgttctttggtttattccttccctttttcaccttgctgtctgcaaagtcagcaaatgcagccatagagtgccttccagctctggagcttttctcatctttagaggaaccagctagagctcctctgtgccgcctttctgggagctgctatttttgttattgcccttcttgccagataagtatgagatttcccaagcctggccaattttcaaatatttgtcctgttgggtttttttttttcttctctttttataagactttgtcagaattttttgatataaattcacaaatgagaaaaaatattttttcaagcccaaatcactcatatgttagttttggtttaaaaaaaaaaaaaatcttccccctggttgtctccataccccaaaggtagcagttacttcctgaagcaaggcaaatacttcctttgacccaaagggcaaagttaatctcccaaaggagtttagcaagggagagcttagaaaggcctgaagctcacctacccttaggtgtcatttgtaaatgcctctttaccaaggaaagatagtgccttaacttgttctgagcacttgtacctgctctgcaatgtgctggattcttgggataaaatgtcatgtaagagtctgaccctacccccaggaagctgtcagtctaatgaaataaataaataatattcatcatttcaattgtattttgggagtcttccagttatcaccaatttcagtctctgagccgaagcgatcaccttagattgtgagccaaggaaggacagatccctgagaagacttcatgcagctctaggaaaagcctatactcttcaatcatctggcttctgatttcgcaatgagaaaactataccctcgtctgcctcaaacgaggaacccctaatacttagctaagaattgctaacattttttggtatctatgtcctagaccctatgtttagtacttgataacttaatctctatcagttggtctcaatttgccaactgctagggaaaaagcatcacactatggagatacggaagcataccaactacccctcccttcaatcagcctgcccttgcttctagcaggtgacccccacctcaccccatcttctatttttcttttctttctttctttttttttttttgacagtcttgctctgttgcccaggctggagtgcagtggtgggatctcggctcactgcaagctccacctcccgggttcacgccattcttctgcctcagcctcccaagtagctgggactacaggcacccaccaccacgcctggctacttttttgtatttttaatagaggtggggtttcaccatgttaaccaggatggtctccatctcctgacctcgtgatccgcccgtcccggccacctgaagtgctaggattacaggtgtgagccaccgcgcccagtcctcagtatactcaaacaatagttcccctcttctgttagtatctgttagcacctatgagacttaagatgtaaaacttttttttttctgagacagagcctcggctctgtcgcccaggctggagtgcagtggcatgatttcagctcactgcaacccctgcctcccggcttcaagcgattctcatgcctgagcctccctcccgagtagctgggattataggtgtgcaccaccacacccagctgggtcttgctttgtcgcccatgctggagtgcagtggtgcaatctcggctcattgcaacctccacctcccgggttcaagcaatcctcccacctcagcctccctagtagctgggattacaggcgtgtgtcatcacgtgcagctaatttttttattagagacggcgtttcaccatcttggccaggctggtctcaaacttctgacctcaggtgatccgcccgccttggcctcacaaagtgctgggattacagaagtgagccaccacacccagccatgtgtttgaactaattctgtctcctatctttttaagtggtgaaagggaggctggatttgtcattagctcaagcataaggaagtcaggattgcgaatagcatttcatgacccttccatctcctttcatattcattaacagagctcacatttaataataatttttaacagtgtttgcaaatgtttgtggcagctttatttgaagtagccaaaaaccggaaacaacttcaacatccctccacagatgaataaataaacattgtgatgtattcatacaatacatactcttcagttatattttttaaatgaacattgatacgtactatataagaatatcaaaataattatgctaagtgaaagaagccagaaaaaaagtatatactgtatgattccattatataaatctagaaaatgcaaactcatcaatagtgacagcagatcagtggttgcttggagtgtagaggatggggatggcaagagggccggattataaagaggaacaaggaaactttgaggagtgatggatgtgttcaccgtcttgattgtggtgatggttcatgggtacatacctaaattaaaacctaacaaattgtacagttaaaatatgtgcactttatgccaattatacctgaataatgctttttataaaattgttgtatgaagcttaaaatctggtctcccaagaccaatattctccagaaggcttctcctgacataacaattcttccttcttctgacaccgttggtcccctgctctttccaaaccctgtgtgcctcggaacaatggccctgcaaccaccgctttccttcagagagtgagccagtccttgccctgtgcttccttctagtcagtgcaaccaaactctgatctggtcctccttgacccctctgatgctcccatggcaccattattttctccaatctcctagcctcttgtaatacttgttgaatttacatctccagccatcctccttcctattttttctccttttggaagaaacgatgcaaaaccttgtttccttgtcacacagtatttcaaaatagaggtgttataattgtatttattttttactgtagaccaaacattactataaacatttagctagaatcactagtttagagaagatgagattttgtaataggttgggaactacttgacataagagacgagaaaggaaacaacatggattagaggcataaaataagccaaggatagtcctaaattctgttaaaagtatctctcacttacctcattcttagtcttgaatatggagacttctggctttctatctccactgggccctggaactgtggcagccagagcctcaccttccaggtaggagatttaaagagtcttttggagaaatctgaccagcccaagaaaaaaagacttttagatagtgacatacaggatcccaatagactcgtcagccaaggcattctatactgaatcctacagtagatatttcattgcctgctcaatttccactcactatgtacatatttttaatcgagaccatattccccacctactttattactggaattcactttgcttgaagggagattaggcagacttcagtcaccatcatcatctagcataccacatttaaaacaaaccaaccttgaatttaactgaaagttgcaagtttactatgtggattaacggggtgctacatacaggtgaggaactttggcagagcggccagtgtgtttttacagacgttcatctttaacaattatcaaattagtttagacagtgctggcttttatacttaaggaaatgaacagacaacctggtcaagtatcattttctagaaaaatagtggggttttttttgtttgtttatttttttgagacggagtctcgctctgctgcccaggctggagtgcagtggcgcgatcttggctcactgcgacctccgcctcctgggttcaggccattctcctgcggcagcctcctgagcagctgggactacaggcgcccgccactacgcccggctaattttttaaaaaaatatttttagtagagatggggtttcaccttgttaggcaggatggtctccatctcctgacctcatgatccgcccgcctcggcctcccaaagtgctgagattacaggcgtgagccactgcgcccggcctgaaaaacagtttttaattacttctcagtgggaggacattttagggcatccgctcttctccaatcacagtcaggtccggcttcctttggtatctgatggcaatggctgaaatgagctgagctgagttcctctcccttcacattctggagtggctctttactgagtaagaaagtgaattaacatttatttagcttcttccttggagctgggtaccgggtcagcctcttttcagagagcttttgctcttgtggtcagagttaccctgcagttttctcctggctcttacatgacatatctcagtacaggtgtcaagccaatgggacaaagccatagtcctgttttccttccctccttccctccctccctcccttccttccttcttccctccctccctccctctttcctattgcccaggctggagtgcagtggcaccatctcagctcactgaaacctccgcctcccgggttcaagcaattcccccgcctcaccgtcccgagtagctgggtttacaggggtgccccactacgtccggctaatttttgtatttttagtagagacgggtttcaccatattggccaggctggtctcgaactcctgacctcaggtgatccatccgcttcatcctcccaaagtgctgagattacaggcgtgagctaccgcgcccgccctctaactgtttctttggagtgctgctaggaagattcaaagaagtgcaaataaggtaccagcggaggctggtttgtctccttgcaatttctttgtgatcacccctgggatcactcttctacagcgttccgacagtgttccaaaaacttccctgcaccagcggcaggggcagatttcccacccggccatgattcatgtagagcagtgtcaaaaccagatcctttccttacacgctcattcgccgaaagacccatgctatgctgacggggttccaacctgggcttcaccgactccacgtcagagggtctgtgattccctgagagggtacccttaggctgagagcaagggcccacctgcactctgcgcgaaggactgtggttttcatcgggttgtcgagagcgttctaacccaaaatgctttaagaatcacaactctagcccttctaatcaaactgctttggccaagacgtccgttttgagttgcatttgaaccctagccctcggtgggaggcacactcacttccacgttcacagttcttggaagcggtcccactgggggcggggctgagcgcgaccgcgccctcaactccccctattgcccgccccggggtggggcataaccacccaacaggctccttactcaagctcgggttcttctcctaggcggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcaggtgagaggcgcacctaccgggccttaggctatcgtgggaactgtgaggaaaagggatggcagcgactgattctcatccctcccttcatttttccctaacacagtctagctgattccttgaggctttgggtcgtttagtctttgacatggtgggcgtggtcctcactttctttgcgcaaaacttcttaccgcccaggttcagtaataatgacaatggcaatgtcagttatttttctaagcccttaacatgtactcagtcatttaatgcttatagtagatacttaaggtagattcaatttttaatcccattttgcggtgaagatctgtaaatacagttgggttaagtaattttattttatctatttatttatttatttatttatttatttatttatttattgagacggagttttgctttttgcccaggctggagtgcaatggcgcgatctcggctcgctgcaacctccgcctcccgggttcaagtgattctcctgcctcagcctccagggtagctgggattacaggcatgcgccaccacgcccggctaattttgtatttttagtagagtcgaggtttcaccatgttggcctagctggtctggaactcctgacctcagatgattcgcctgcctcagcctcccaaagtgctgggattacaggcctgagccaccgcgcccgggtctggttaagtaatttatttaaggtcacactgttggtaagcagaggagctaaaatgaggcagcaaagttgtttttttggggggatggagtctccctcttgttgctctggctggagtgcactggtgccatctcggctcactgcaacctccgcttccccggttcaagcgattctcctgcttcagcctccaaagtagctgggactacaggcatgcaccaccatgcccggctaattttgtgtttttagtagagacggctttcatcatgttggtcaggctggtctggaactcctgacctcaggtgatccacccgcctcggcctcccaaagtgctgggattacagccatgagccaccatgcacggcctaggcggcaatgatttattttttttatttttttgagacagagtctcgctctgtcgcctaggctggagtgcagtggcgcgatctcggctcactgcaagctccacctcccgggttcacgccattctcctgcctcagcctcccgagtagctgggactaaaggcgcctgccaccacgaccagctaatttttttttttgtatttttagtagagacggggtttcaccgtgttagccaggatggtctcgatctcctgacgtcgtgatccacccacctcggcctcccaaagtgctgggattacaggcatgagccaccgcgcccagcctaggaggcaaagattaattcttgtgagcaatgaatatttaccagagagataaagagttaaaaggcacatgcactggcacatctggttgtgggatttaggctggacccaaaagagtaataatgaacagtgtagtgtgtaagtactctgtgtgtatgtgtgtgtgtgtgggcacttgtgtgacacagtaggtgcttccagtgacaggaagtttgaactttggtggcctggaaaactttcctagaagaagttagacttgagctgattttggattaaagggtaagactaacaagtggagaagagttcaacaggcgatatcacaagtgcaaagtgtggaggcaggaatacgcatgggacattagggaaacaatgagtaaaccagcgctcttggagtgacttttcaagaagagaaaataatggaggtagaaagaaccagattgtgaaaagttttagaaccttgactaaggaaacttttgtattgtcagtaggaatctttgtgaatttcccagcaaaagactaaatacctattaatgaggaatattatttctggggctgacttccactttggggctcatagtcagtatgagtgagctgctaattctaggagagagaatgtttgtagaatgatggaaatttactgagtgccttgtgactgacatacagtaatcattctaagtctatagattgtttttgcacactaaaatggtagatttacctaatagtgttatcctttacggtatgaaaaataattttttttggattaccgcactaattttttatattacagagagtggatctttcctacaattgctactggaagggaactatgaagccatattcttaaattcaatgactcaaaatatttttaattcaacaacaaccgctgaagaaaagattgatagctacctggagaagcaggtagtaacattcctggattactcaacagatttggacacaacggaaaggtagaattttatttgaaattttcatagaggaacagagcaaatacatttaatagcaccttgacagggtaaggccctgattttagcagttgagaaaccttgccttatattttactcaagactcatggtgtaccaagtaatctatgtaaaaactcatccagaagtccatccagaatgaagaagtaaagtggtgcaggataaaatggtttcatatatgagactggcacatattttggtgttaactgcaaatgcttaggtctggtcggctttacccaccggcaaaacttcagaccttatttcctttaacttaaaaacatactttcaggctgggtgcagtgcttcacgcctgtagtcccagtgctttcggaggccgaggcgggcggatcacatgaggtcaggagtttaagaccagcctggcaaacatggtgaaaccccgtctatacaaaaatacaaaaattagctgggcatggtggcatgcgcctgtaatcccagctgctagggaggctgaggccgaagaatcgcttgaacctgggaggtggaggttgtagtgagccaatatcccgccattgcactctagcctgggcgacagagcgagactctgtctcaaaaaaaaaccaaaaaacaaaaaacatactttcaatcttgttatttctgcatagctgagtgctaatttgtaactatttattatgttttagattattatctttatagagctcagagaacttaatgtttttgtaaggaagcccttggtttaccttcttccattaaagtttgtgtaattttatagggttaagtatagcagatagttacacagcagggaaacctaagcttttcagtggcttatatttcattgttataaatttgatacctctatctttcgtctactatctgtggcaaccatgtcaagctttaattatcttataaatgcatgcaattttattttaccattatttctaggaaatagcttcatttagtccttcaacaaataaactattgtagtagatgtggaggttctgaggatgaataaagcataacccatattcataaggagtttgcaaaagaatgctactacaggcttttaattttattttgaaaattaatattattcattttcttttttcttttttttttttgatggagtatcactctgttgcccaggctggagtgcagaggcgtgatctcggctcactgcaacctccgcctcccaagttcaagtgattctcttccctcaggttcccatgtagctgggattacaggcctgtgccacacctggctcattttttttgtatgtttagtagagatggggtttcaccatgttggccaggctggtcttgaactgctgacctcaggtgatctgcccacctcggcctcccaaagtgctgggattacagacgtgagccacttcgcccagcctccatttaattttttttagtttactggtagttatgttcctttggtatcattcttttttttttttttttttagttcctttttgtagagatggtgtcttgatatgttgctcaggctggtctcgaactcctgggctcaagcaatcctcacctctgcctcactaagtgtggggattataggcatgagtcactccgcccggctggattctcattgctttcttatatgtgtgcactctcatagcaactagccttgtggcacccattaaaacaacacattcacacaaatgcattattcactgatataccagatttctatcttgtcacataaagctaaaaagagacatttcagttgactcattttcagacatttgaaagttaaagtgtattttcagttcaccttatggattttgttttttgattaggacagtttattaaggctgttttctccaaatttccaaacttctgattgcataccagctcttttgttatcttttttctctaatgctgcttatttgcattgcatccagagttttatatttttgctaccataggcttgtatgtttgatttttttttttctttttctgaaagactcttccttttaaggaagggcctaggggctgtggggaaaaaagtgattactaatactttctcttcagaatgaaactccaggattccctggctgttatttgctagagttggatctgtacctatttagatcctaatttagggtttggcacattatggctggcaggctaactaagtggctaagaattaatgggttttacatttttaaagggttggaaaaaaacaaacatgatatgcaaagcctaaaatatttcatatttagaaaaagtttgcctatccctgtctcacatcacagcaagactgaaaaatagagttttcactaaaatatctatatgttttgttgttgttgttgttctagcatttggtggtatgggattggtaaacaattagcaacaactttatatcatcacttttcttttgtataaagtcagttttctatacatcttgcaacatcagagctgttaaagggagtgcaagaaaaacttatagatgtctgatcagaacctaaatcaacaccgttcaagataattttccgtggagatagaagtgctctctatcttcattgcccacatggtagccactagccacacttaactattgagcacttgaaatatggaaagtatgactaaggaactgaattataaattttattaattttaactaatgcaaatttaaaccatgtttggctcgtggctataatattggatattgtagacctaatttcttttttttttaagagagacagggtctcgctttatcatctaggctggagtacagtgctatgatcaaagcttactacagcctcaaactcctgggctgcaagcaatcctcatgcatcagcctcttgagtagctgggatgtaccaccatgccggctaacttttaatttttttgtagagacagggtctcactatgtttctcaggctggttttgaactcctgggttcaaatgatcctcctaccgtggccttccaaagtgctggaattacaggcatgaaccactgtgcctagctaacctaaattgttttaagttttagaaatttttttttttggtaatactctaggatagtctcaataaatgttgatagatattattttcttaataaaactgaaatggaatagtgtgtttgagattatacagtgatagtagttcatatttatttctttaaccattcttatatgcagacaacagttgatatttctacttggtgtgagcagtttgcaactttttgttcagagcaactggacggggccccctgttgacttacaccctcaggactttttgtcatctgttttgttccagcaattcagtgaggtatgcttcttgaaaatgttgtatgtaattattattatgttatttattttttataagcaggtctttataaactggaactcatagtaggaaagaaacatgactttatggtttgcacaaaagtactaagaatgcttgttcattgatcagattttcacagatttccagaagttcctttgtcaaactcctcttcatacacactccattttatggagctgtgttagctgtgttttttaatgaaagtacagacagctgcaccagttgtttagttggttgtatcacctcagttacataaagattttttttttttgagatggtatctcactcagtcatccaggctgttgtacagtggctggattacagctcactgcaccctcaacctactcaggctcaggcgatcttcccacctcagcctcccaagtagttgggactacagttgcatgccaacatgtccagctaatttttttgtagagatggagttttgccatgttgcccaggctggtctgaaactcctgggctcaagtggtctgcctgcctcagcctcccaaagtgctaggattataggtgtgagcgctgtacataaagatctttaatggcaaagcagcaaatctggaaatctgtttaattttatttcaggtaagtttttaactaattaattaattaattttttttgagacagagtcttgctctgtcacccaggctggagtacaatggcgcgatctcagctcactgcaacctctgccccatgggttcaagcaattcttctgcttcagcctccctagtagctgggattacaggcgtgtgctaccacacttggctaatttttgtatttttactagatgtggggtttctccatgttggccaggctggtcccaaactcctgaccttaagtgatcctcccacctcagcctcccaaagtgctgggtttacaggcgtgagccaccattcccggcttgcaggtaagttttgatactgtacttaagaatggctcccaggagtggtttgctcccaggggtggctttaaattacaaatactttattaaagtttctggcacagcattgcttcatggtgattattatccattgtgaagataatattatcgatctgtgccagtgtgtcgccaatagagcttgcagtttgagttcctcaggaatcttgagctcctatatagagggtctggctagtatgagatgatctacaaaagaagtatggtttaaatcaaagtaagaactttgatttatccagccactttggtgattttgaacgtagctatccaccactcagcctggaaaaagctgagtgattgatagctatgttcaaaatcaccaaattgtatccagaactcgtgcagcaaaacagacctagtgttacctggtttctcagaattaggtgtagcaagtaggccgggcacagtggctcatgcctgtaatcccagcactttggaaggccaaggcgggcggttcacgaggtcaggagttcaagaccagcctgatcaacatggtgaaactccgtcttactaaaaatacaaaaattagccgggtgtggtggtgcacgcttgtaatcccagctactcaggaggctgaggcaggacaattgcttgaacccgggaggcggaggttgcagtgagccaagatcacgccactgcactccagcctgggtgacagagtgagactccatttcaaaaaaagaaaaaagaaaaagaattgggtgtagcaagtaaatgtggaatagagttattagagatatgtgttaataatttgatgggggggtagaaagagaagaagtgcaaaaacaagcataaagtgaaaaccacaataattaactctttgcatatcagcttagtgagtcactatatatacttcattagagtaattttaatccataatgctgatcctaattataactgaaaggttaaaagatgttttgtgtcttatgtctatgaagggaatttataatttatattctacagaggttttcatccaaaatgggagtaaaaaaaccccaaaccctaaatgattgtagcagttaaagagataagcttcagttatctagaaatgtacttaggaaacatctcattccctctcttattatgtatgaatcagtttctggcttctatggccctatagtatagattagaaatccaccaaacagccaaagccataaatatctcctgaacactgatgtgtggtttgaatggtacttaattcgcatttctttttttttgttttgagacggagtctcactctgtcgcccaggctggagtgcagtggtgcgatctcggctcactgcagtctctgcctcccgggttcaaatgattctcccacctcagcctcccaagcagctgggactacaggtgctcaccaccacgcccggctaatttttgtatttttagtagagacggggtttcaccatgttggccagggtggtctcaaactcctgacctcaggtgatccacccgcctcggcctcccaaagtgttaggattatggtgtgagccactgcgcctggccttaattcacatttcttgtgccaatttggtccttacagatttgaggtaatctataggtgaaaagactgaagctcagagtggtaaaagaatcttgtcagagatctgtagctggggcattggaatccacattttctggttccaaatccagtactcttctatactagtgtagaagcacctgtaaattcaggtagcaaatcaaaacaatatggaaatgagtttcatgagaagttcagaccataagaaatattgccattaacaaagagatttgtggaagctggattttgtcaaagaagaccttttagttggaagtggaccttgagctagaacctgaaggatggttagaaaatggatagagaagaggaaaatatccattctaggtgcagtcatatgagcaggaatttagaggagaggacagcatagtgtttgtgggaaaaggatgctttgaacttgcctcttttagcagtgaaaaatcacttgatggaggtcatttggagttgtaggaaactttgactaagtctttgattttaacttttttattggaactactgccaacacttaaaagagcatatgaaatgtatacaatttaaataataaatctcctttgtactcacaacctagcttgagtgtcacaggtaatgctctccagatagtataccatgtgctgtctccctgtataatttttatttgttgctatgttaaattacttgtttgttctttatatttagggattcatgtagaagataatgacctgaaatttgtggtagaacaggcagacatatttcttgtctcagagtgattaggagaaggattctttttctttttctttctttttttttttcagacggagtctcactgtgttgcccaggctggagtgcagtggcgcaatctcagctcactgcaacctccgcctcccgggttcaagtgattctcctgcctcagcctcctgagtagctgggactacaggcgcccgccaccgtgcctggctaatttttgtattttttaatagagacggggtttcaccttattggccaggctgctctcaagctcttgaccttatgatctgcctgcctcagcctcccaaagtgctgagattccaggtgtgagccaccgggcctggccaggattctctttcttaaagacattccttattatcttcttgtgctttaccagtttggcttgggctttaggaaatcagcttgttatatctacttgaatttacaacatgatccgatgaggctgcaggtctagtttgggcactttaggcaggttcttctgagttctcaagtcagtatattcactgtacattcagtacctccagttggggttctcacagaatacctcatttcctcatcatgtccaagactgaactcatgatgaaggtcttctctttttgtgtctgtatttcagttacacacgccaccatggtgtagtgccagtcagaaggctaaaagtcatcctggccatgtccttgaggctctccaaatgcttagcatagccctagcccttcctgaggggcaggaagaggtagagagatctgtttccagttcccaaaccaatgttctttctaccagcgtgggctggtttgggaattgatttgggaattggaaacatgggcttcacttaatttttatggatctgtttcctcacctctaaaattgaggcagttgtaaaaacttgataatatttcattaattattgaagttttttttttaaataattccttgtatgcttagcagagataacagtaggctttgtggttgtggaggtaattcatattaaatctttattcctctattacactcttgaatgatgatgaaaataggacagaggatgaactcacagttatttccttctttctcttttatttattgttttttatttttttctaaggcagtctcgctctgtcgccccggctggagtgcagtagcatgatcacggctcactgtaacctccgcctcccaggttcaagcgattctcctgcttcagcctcctgagtagctgggattacaggcatgtgccactatgcccggctaatttttgtatttttagtagagatggggtttcaccatgttggccaggctgttctcgaactcctgacctcaggtgatccacccgcgtggccttccagagtgctgggattacaggcatgagccactgtgcccggccctccttctttcttctattgaatactttaaacaatattcaaaatattcagtattcaaatatttagtattcaaaatactcagtattgagccagggagtggcattacttggattgtttagtttaatccttacaagaaccctctgaggtataggttcagttatttcattttttttttgatacggagtcttgctctgtcacccaggctggagtgcagtggcacaatctgggctcactgcaagctccacctcctgggttcacaacattctcctgcctcagcctcccaagtagctgggactacaggcacccaccaccacgcccggctaattttttgtagttttaatagagacagggtttcaccgtgttagccaggatggtcttgatctcctgacctcgtgatccgcccgccttggcctcccaaagtgctgggattacagatgtgagccaccgtgcccggcccagttatttcatttcataattgatgaaactgaggcttcatcaggaaaacaattgtgggaaaaatttacatgtgctcacaaactaatgagaagcagagaaaggacactgtcctgtgcatgtgacattggaacccatgttcctgatgggtgaagattcttgctcgctattgtatggagctgttaaaattctgccatccaaattttaacaaccttgtccattgtaaaaaaatctctgtacaacaggagagtgcatttttcaaaggcatccttttttttttcagccttctgctcactctggtgtgtggtcatatgcccattctgcatttgatgcatgagaccttgttgattgtttggcttgatagaaattatggagtagagacttacttcataatgacattttccaggtattgaagcttaagtgaaatgtaggtgtttaatataaatatcaaatacactatttactataaatactttaatatagggatgcttttcattgagataatattttgttgtaagtgaatttatgaagtgatgatatctcttcaatgctagcattttttttgagttccttgtttctctaaagtttgaacatgccaggcgcagaagctttcacctgtaatcccagcactttgggagaccaaggcaggggatcacttaaggtcaggaattcgagaccaacctggccaacatggtgaaaccccatctctacttaaaatacaaaaacttagctggatgtggtggtgcgtgcctggagtcccagctattcgcccaggcaggaggatcacttgagcccgggagatggaagttgcagtgagccaagatcacgccactgcactccagcctgggcaacagagtgagactcccatctcaaaacaaaaacaaaaacaaaaacaaaacaccaaaaacccaaaaaatcaagtttgatcagatgggtggccatccatcagggcaggctggatttatagatgtctaagggcatttgcagtgttataattctgtccagtgccaattgctgtgtaatatattaatgcttttgtttcaaagctgagttgactggaaaatctttgtattattacaagacatataaagattaatattttgttaaattatatcatcttagtttataatccttttttcaggttaaaggactggatgcatttgttctgagcctgctcactctagatggtgaatcaatctacagcctgacctcgaagcctatactactgttattagcacgcattatcctagtgaatgtaagacataaactgacagctattcaggtaaggaaaggatccatgagattcataccctggtatgacttttgtgcttattaacaccaggctgtagatgtgttgctgacaatgtcttggtctattttgttttctaagtcttctaggtatgtaatttaaaaatctgatgaaaataagcaaaaacttttcttccctcatgagattgatctagtttagaatgagattatgttgcacctccttaataggatttatgtgtgtactgtgtagatataaatgttcatttgcagaaatcttaaatatcgatttaaaaatataccttgggctgggcatggtggctcacgtctgtaatcccagcactttgagaggctgaggtggacgggtcacctgaggtcaggagttcgagaccagcctggctaacatggtgaaaccccatctctactaaaaatacaaaattagctgggcgcagtggcgtgcacctgtaatcccagctacttgggaggctgaggcaggagaattgcttgaacctgggaggtggaggttgcagtgagccgtgattgcgccattgcactccagcctgggcaagagaacaagactgtgtctcaaaaacaaaacaaaacaacaacaacaacaacaaaaacaaaacaaaaaaagatatacctcacagtcttttatgaatttcatgtaggataatgagcagtgaccaaaatttaatgggtcttaatttctgttttctggctcacattctatgttatgtcattatttgggttggatttagtaaagcatttgttaaatatctattatatggtttcttcatataaactagtgaggacaaatatacacacagaatgctaatatgcagaaagaaaagacagtctttggaggtttagtggaggttgtcagccacgcagtgtgcagtctgtgttgcgctattcaactctgctgcattgtagtgttagagcagctgtagacaatgtttcattaaatggacatgactgtcttccaataaagctttatttgtggacactgaaacttacattttctatacttctcacattcacaaaatattattcttgatttttcccagtgatataaaaatgtaaaaacgattttcagttcttggactatacggaaaccagtagtgggctggatttgcgcacaggctgtgcctggctgacccctgctccatctgattgttgcaacctggtgtgctgcagaccccatagtgtcagaaatagtacatctaaattttatgtgaaatctcccagttttggctgaaaatttttaagaaatgcaatagttctttcttttttttttcgagatggagtttcactcttgttgcccaggctggagtgcaatggcgcgatctcggctcaccacaacctccacctcctgggttcaagcaattcttctgcctcagcctcccaagtagctgggattacaggcatgcgtcaccatgtctggctaattttgtatttttatttatttatttttttgagacagagtctcgctctgtagcccaggctggagtgcagtggcgtgatcttgactcactgcaagctccacctcctgggttcacaccattctcctgcctcagcctcccaagtagctgggactacaggcggctgccacgatgcatggctcatcttttgtatttttagtagagatgggatttctccacattggtcaggctggtctcgaactcctgaccttaggtgatctgcctacctcagcctcccaaagtgctgggattacaggtgtgagccactgtgcccggcccaagcatcacaatatttctataggtcaatgtagacttggtctgtgctgtgtaagggcttactttcctaagcatttaagtttatacactaaattttttttttttttttttttttgagatggagtctcactttgtcacacagactggagtatagtagtgtgatctcggctcattgcaacctccacctcacaggttcaagcgattctcatgcctcagcctcctgagtagctgggattacaggcgcccaccaccacgtttggctaattttttgtatttttagtagagacatggtttcgccatgttggccgtgttggtttcaaactcctagcctcaggtaacctgcctgccttggcctcccaaagtgctgggatcacaggcatgagccaccgcacctggcctaaatttgttttaaaagaagaggttagaagggaagtggtgcctctatttgcaactctcatgagagccagaggatttggaagccattgtactagaggttgttttttgtttgtttgtttgttttgttttttttttaagacaggctctggccccgttgcccaggctggagtgcagtggcatgatctcagctcactgcaacctccacctcctgggctgaagccatcctcccacctcagcctcccaagtaacttgtactacaggcatgcgccaccacacccggctaatttttgcattttttgtagagacagggtttcaccttgttgctcaggctggtcttgaacttgtgggctcaagtgattcacctgcctccatctcccctaagtgccgagattataggcataagccaccattcccagcctagaaaggtttttgtttttgagacagcgtcttgctctgtcgcccaggctggagtacagtggtgtgatcttggctcactgcaatctacgcctcccaggttcaagtgattttcccacctcagcctcccaagtagctgggactacaggtgtgcaccaccatgcctggctaattgaaggttttttaatacacggatttcaacatgtcttagcatatatgaggcttcgtcttttgagctcttagtgacagtagcttgagtaaaaaatttttcccctaagtaagttgatctgagttaaatggtcttaaagactgacgattactttgctctattgttttatttatttacttatttattttttgagacagagtctcactctgttgcccaggctgaagtgcagtggtgtgatctcggctcactacaacctctgcctcctgggttcaagtgattctcctgcctcagcctccctagtagcttggattacaggcacgtgccaccatgccttgctaatttttttgtacttttagtagaaatgggattttactatgttggccaactggtctcaaactcctgacctcaagtgatccacccaccttggccttccaaagtgctaggattacaggcgtgagccactgtgcccagctactttactctaggtaaagtatcaccaagccatgaggctgcctaatggcattattttctttctagtgagaacttatggtcactaatgaatgagtgagacggtttttaagttgctcaaaagttttcttcatcaagaatattaagcattgtccaggcgcagtggctctcgcctgtaataccagcactttgggaggccaaggctggcggatcacctgaggtcaggagttcgacaccagtctggccaacatggcgacaccctgtctctagtaaaaatacaaaaattagccaggcatctctgggcatggtggttcacgcctgtaatcctagcacttttgggaggtcgaggcaggtggatcacctgaggtcaggagtttgagaccaaactggccaacacagtgaaaccccgtttctattaaaaatacaaaagttagccgggtgtaatggcgggtgcctgtaatctcagctacttggaaggctgaggcaggagaattgcttgaacccaggaggcagagtttgcagtgaatcgagatcgttccactgcacaccagcctgagcaacacagcgagactctgtttcaaaaaaaaaaaaaaaaaaaaaattagccaggcatggtggtgcatgcctgtaatcctagctactcaagaggctgaggcaggaatattgcttgaacatggaaggtggaggttgcagtgagccaagatcgcgcaccgcactccagccgaggcgacagagtgagactctgtctccaaaaaaaaaaaaagtatgttaagcatcatttgaaaaataatatatatactgtcaacaacttaggagaattaataaatatgtggaatactagttgtagatgtcattcttgtagggttgcagaggcaagttaccttaatttcttggcagctgtaaacaacttttgacttctgcttaaaaacctgttttcctgtagtatattactatgtatacctcattttgtgctgaaattttgcctttttctttttcttttttttgagatgggagacagggtctcactgtgttgcccaggctgatcttgaactcctggcctcaagtgatcctcccacctcagcctcctgagtagctggaacttcaggagcacaccatcctgcctggcttctcttgccattcaactgaagcattattctttctattatagatttttcctgtgggtctttactatatcattcttttttccctccctccctccctccctcctttccttcgttccttcctttcttcttttcttccttcctttctgcttttttttttttttttttggagatgttgtcttgctgtgttgtccaggatggccttcaacttgtgggctcaagtgatcctcctgctccagcctcctgagcagctaggactataggcacctggcttatatctttctcttaatggtgttattaaaaatggctgatttgatgaattaagataaaataataaagaaacattacatacttatccaagttaattttaaccttttaaattaatttttgagtaacctgactccaagaaatgtatcaagttatttatgatgatattatttttgtgaaattatagaagaagcagattttcccacaacccctaatctgtgaagtatatagactagaattggtactatgtaagtggttgagtaaaatgagtcttggttttgaaatcaacagctatgtgaccttatgctagttaatttctctgaatatcagtttccatttataaaatgggataaactggcaaatatttatttggtgtcttgtgagtatactactgctccctgctgtctgggaggttctaaactattgtgacttctcagtcagaccattctgtaataagtgttataatcaggagataaaatctagaaattatctaaagcaagacctcaagttcacttttttattaatgcctcaattttttctttctttgtttctttttttaaaattgtattattattatgctttaagttttagggtacatgtgcacaatgtgcaggtttgttatatatgtatacatgtgccatgttggtgtgctgtacccattaactcgtcatttagcattagatatatctcctaatgctatccctcccgcctccccccaattttttctttctttttttatttttttgagacagagttttactctgtcgcccaggctggagtgcagtggcgtgatctcagctcagtgcaacctccgcctcccgggttcaagtgattctcctgcctcagcctcccaagtagctgggactacaggtatgcaccaccaggcccggctaattttttttgtatttttcggagagatggattttcaccatgttggtcaggctggtctcgaactcctgacctcaatgatctgcttgcctcagcctcccaaagtgctgggattacaggtgtgagccacagtgcccggcctcaattttcaattttaatttttttttttgagatggagtctcgctctgtcgcccaggctggagtgcagtggtgcaatcttggctccctgcaacctctgcctcctgggttcacgcgattctcctgcctcagcctcccgaggagctgggactacaggcgcccaccaccatgtgcagctaattttttgcatttttagtagagacggggtttcaccatgttagcccagatggtctcgatctcctgacctcgtgatccacctgccttggcctcccacagtgctgggattacaggtgtgagccaccatgcctggctcaattttttaagttttatttttgtagagatgggatctcactgcattgcccaggcttgtctgaaactcgtggcttcaagtgatcttcctaccttggcttcccaaagtgctgggattaacaggcataagctactgtgccagccctctatttttatattaagcaattcttgacaaactgaaaaggtctgttacactgactagtagaaaaataggctatgctttctatatttggtttttttttttttttttttggagaccgactctcactctgtctgtctcccaggctggagtgcagtggcgcgatctctgctcactgcaagctccaccttccgggttcatgccattctcctgcctcagccccccaagtagctgggactacaggctcccaccagtacgcccagctaattttttgtattattagtagagatgggatttcattgtgttggccaggaaggtcttgatctcctgaccttgtgatccgcctgcctcagcctcccaaagtgctgagattacaggcatgagccaccgcgcccggcctctatatttgttttattcttccctcccccatataaagatttttggtttgagagttaatttatagatctgatttttgagagttcagcatattatatgtttttttttgtttgttttttgtttttttttttttagagtcagagtctcttctctgttgcccaacctggagtacagtggtgtgatcacagctgactataaccttaaactcctgagtagctaggtttacagatacgcaccaccacactcagctacctaaaaaacaatttttgtagaaatggggtctctctgtgttgcccaggctggtcttgaatttatggcctcaagtgagcttcctgctacccaaagtgctgggattgcaagtgtgagccaccgtgcctggccttgtattatgtgttttcttaaaagtgaaatctttttgactggatgtatctaaattcccatgtctagaaaagtaaaagaataagctgccagacctgactcacttattgctgacagcagataagggacagataattgagatgtaaactgacttcatgctatagtgataggaaaagaatgaaaatgacgcaacacctcagggaattcagttaaaaactgtctgaaatttctttgctattagataattttatatttccttacatggactgaggaaacagtattaatttgaaaggattttgtcatggagtcaaaattcatttgtggttgcatcacggttgtagtagttgtggtgtataacactttagaagcgaaccaggctatggtgtgtagcagtttagaagggaacgtcttagtcaaatgaagaaattaagttcaagcaaaaaagttctttggagccaggtgctgtggcatatacctgtcgtcccaggtacttagaaatctgaggcaggaggatggcttgagtccaggagttcaaagctgcagtgtgctatgatgactcctgtaaatagccactgcactccaacctggacagtgtactgagaccccatctcaaaaaaaagctttttggtaattgtcatctcatatttgcaggtaactaaaaggaaaactaattgttagactttcatgtaatataatgtaaagtaatatagttacaaataatttataatgagcttatcaaaattacttatcataacttgtacacatgtacatatacacacatgcacatacatagaggaagctctggaggaatgtaaacctttgtcactgattttttccgctggaggaggatgatattggggctgtggaagagagattttcactcttcaccgtatatacttttttttttgagacggagtttcactcttgttgcccaagctggagtgcagtggtgcaatcttggctcactgcaacctccgcctcctgggttcaagtgattctcctgcttcaacctcccgagtagctgggattacaggcgcatgccaccacacctggctaatttttcgtatttttagtaggaaccgggtttcatcatgttagccaggctgctcttgaactcctgacctcaggtgatcagccccacctcggcctcccatagtgctaggactacaggtgtgaaccactgcacctggcaccccccctttttttttttttttttttttaaaacagacttagtcttacagtgttgcccacctggtctcaaactcctagcctcgagtgatcttctcatttcagcctcctgagtagctgggattataggtgtgaggtaccatacctggccatacttttatattggcttgttgttccttgtttttattttttttaagtaaatatatgttgatcaagtaagaaaaagcatcagcgaataaaagaaaaagctactatatgctcagcttgtgcattagtcaagacaatgtctaaaatccagtttcctactgggtgcagtgcctcacatctgtaatcccagcactttgggaggccaaggtgggtggatcacttgagcccaggagttggagaccaacctgggcaacatggcaaaaccccatctctaccaaaaaatacaaaaattagctgggcatggtgacatggccagtagtcctagcaactcaggaagctgaagtgggaggatcacgtgagcctgaggaggtccaggctgcagtgagctgtgatcatgccactgcactccagcctgggcgacagagtcagaccttgcctcaaaaaaataaaataaaaaataaaaaaaagcagtttctgccctcagaaatgtatggctcaaatagagttataaacttgaaaaacaggtgctgtccaatatgatgccaacttctaggaacagtgtagaagttcaaagaagtgaaagatcagtatgtgccacactagcaggagaagactgtaaggaagaggtttcatacaggtgtggaagcaatcttctcagattgggggaacatctgaatccaaggtatttcttactgtgtagattatgtaaaatacattgctttgaggaggatatagagatgaataagacatgatttcttaccttgttgggtagtagacggtgaacaacattggaacctgagatgacatacataaaatacagtggaatgtgtttgcaagggaattacagataatgtgctggaagttcaggtgatggaaaaatcacccccacagggggttcttgtggggcctctgaaggagttggtactcggattaaagtggtgatagagtgccacagagcaggatgaatacaacatttttttttttttttttgagacagggtctcgctgtgttgcccaggctagagtgcaatggtgcatcctcggctcactgcaacctctgcctcccaggtttaagcaattctcctgcctcaagtctcccgagtagctgggactacaggcgcctgccaccacgcccagctaatttttatatttttaatagaggcagggtttcaccatgttggccaggctggtcttgaactcctgaccttgtgatctgcccgcctcggcctcccaaagtgttgggattacaggtgtgagccatcgcacccggccacaacatatattttaaaggaggagttggtaagttcaaaatggcataaggaagtccaagtggctaaaaaaaaaatacaggtttgagaggatggaggtgaggtgttattcttatggaagacacagatgtgggttttggtattattactgaagagagtagtggatgggtaatcttattgaggaataaatttaattttatgaatgtaaaaaaattctaaaaatctcagttaatgtaaaaagagttttctaaagtatccttttatttcagcttacgtggtgttttttcctagagcttgccatggtggactttgagatgtgtgaatattcatcagcatttgcttgaggaacgctcacctctgctttttactcttgccgaaaactgtattgatcaaggtatgtagcagatttttgtttgatatgggcatgtagctcagttctaattacttggctgagatactcctttttagtttattttttgtccggtagtagtgccttttcgttttgagttgtttctttttttttttttttttttttggtgtagaatatcacaagttgttatgttgtcagattatagagttccttttagtctttttagtttaaaaaagataactactttcacttacttaacctacttagggtgatttgctctatgtaggtcaccatgattttatctcaaattgtttaaagatattttaatattttctctgttctttaagaagcctcattggaaacagatgtactctccttagttctttttttaaaaaaagtccttaactaacttgagctggagtaaattatgttaaattacacaaagaataagaaattatcctatatcctattgagtacatcaagaaaagcgtaagaaaacagttgatagaaaataagtttcactgaagttaacaatgggtagggaggctattttgcatttcattttattagtattttttgtaacatataatatacatgcagaaaaatacctaaaacctaaatgaaaaatttgccaaataattataagccaaacatccatgtaagtgcctcctgctgcctttgttgcagatattcctcctgtatcctagggaaagactttggaaaagaggagaatcttaggtgccttaatacttggtttccagtcttcctggttttggggattttttttttggcaaaagttgccacacaaaacaaaaacaaaaacagattctcttgtggtgaaggaatatgtgaacgtaaatgaacttggacttgaccatgagtttttgagttacagagacgggatttgattttagctgtgtctggttccaaagcccagactcctttcagatccaacagtatggaatgaatatgtatgtgtgtgtccaagggacatgaggagtggtagttagcatcattctatgtggagaaaagtgatctgtacttgatggaggtagcacattcatgaaggtataacataactctcatgtgtgtgcatgtataatataaggggctcttgtaccttttgggggtctgtttccttcaagagttatttttgagacagagtttcactctgtcatccaggctggagtgcaatggcgcaatctcggctcactgcaacctccgcctcccgggttcaaacaattctcctgcctcagcctcctgagtagctgggattacaggcatgtgccaccacgcctggctaattttgtatttttagtagacatggggtttctccatgttggtcaggcttgtcttgaactcccgacctcaggtatcagcccgccttggcctcccagagtgttgggattacaggctcgagccactgcgcccggcgtccttcaagagtttttacagtaacaagctaggccagaatacagtggagaggactatagcttgtttagtcataaatattcctaagccaggtgagtggttgaaactaatttctcagtttttattttattctaggacagaaatacataaacatatgctaatcttagataaaatgaccatctatacataattcaaatagagataataatgaaagtattattcaatcagtataataattgattcatttatgttgtttgttccaggacttagtttatattctttcaacatttttaggtaacataagcctgggggtctagcagggggcctgttagatgtgagcataaacattgtaagtcatcccttggtatccaagggggattggttctggaacctgaccctctcataccaatatccttgtatgcttatgtatctttttaaaaggtaggagccgggccaggcgcgttggctcatgcctgtaatcccagcactttgggaggtcgaggcaggtagatcacgaggtcaggagttcgagaccagtctggccaacatggtgaaaccctgtctgtactaaaatacaaaaattagctgggcatggtggtgggcacctgtaatctcagctactcaggaggctgaggcaggagaatggtgtgaacccaggaggcggaggttgcagtgagctgagatcgcgtcattgcactctggcctgggcgacagggcaagactccatctcaaaaaaatatataaataaataaataaaaataaaataaaataaaaggtaggaaccatatggtatattttggagaggattctattttatgagttaaaattaagttccaaaccagaaactaagatagctggaaaatgtgactctaagtgactcattcccaaagaggtctcagttcttttctatattatatttcagcatgtcatttgctttaccttgcaactaagaattttttatgttgctgttctaggctaatcaacggcacttttcagtttatctagtcataaaatggtccattttggctaggtctaaatagattcgtagatagtgctgaattataacttttcatgcatgatttcatttttaaaatgttttgttctgggatttgatccaaatgtaataactgaaatacgattcagcgtccagagaagggtattatatttgaaatgttgcccttgaaggatcatcagaaagttggcaggattttttttttcgttctatgaaacataggcaaaggattttatgaacaactatgatatttaggtttttgtccaggcgtgttacaccagtataatacagtggaatggagtctatcaaaatgtcaacataactttgctgggctgattacatctataataggagtaggtcagaatctattcctcagtacaatctaaagcattcttttggatgtcacactaaatgaaagcatgcttctctaaagactattcagggcatacaacaattgatcatggcatccagtgctgaaaacatgttatgtatagtgcatgagatgtaatattgcactttagctgtttgaagaagacctcatgaagtcgctaagagaaactgggttaaaatactttgtcatcaagtcctgctgtgacatttcaggcagctctgtgactctgggattaggttgtttccacgttgaaagagtgttcaaaaaaacagtctccacggtggctcatgcctgtaatcccagcactttgggaggctgacgcagtggatcacctgaggtcaagagttcaagaccagcctggccaacatggtgaaaccctgtctctactaaaaacataaaaattagccggacattgtggtgtgtgcctgtaatcccagctactcaggaggttgaggtaggagaatctcttgaacctgggaggtagaggttacagtgagccgagattacaccactgcactacagcctggatgacagagtgagactccatctcaaaaaaaaaaaaacaaaaaaaaaacagtcttttggtgactgatgcatacgtgcgtacgttgatttcttttcataaatttgatactttggaataaatgttattgaatgtactaaatgtcattgtctgtaattataattgtccattaaggatttcattttagcatagcatttaaataatctcgtgagaagagattttggttttagcatacattttaagtgtgggtgacattttgatccagaaggtcacaaatattcatttccagggagaacctcctgatttattaaaataataatatatgcctaatgtaaaccttgagttatctatcttcaaagctcaaaactttgcttccattgttgactcattgctttccaccattctgcgtttctagccagttcttaaatcttaccagttcttccccaagggtcccatattgatctgtcttttccatatctacagcttttatcctaatctgaaatctttagtttggaaaggccctttagagataatcttgtctagttaaatcattttacgaagaattgagacttacagaagttgcccaagaaccagcacaatgatgtggcgtttctgactccaagtcctgctgacactttcccttgctttttgcaagctggtcagtaaggcagaattctagtaactaatgataatgcagctaacatttctatagtgtatacaccacatcaagcagtctttgaagtctttaattatattaactagcttattcctaacaactatgaggtagagccaaagatggtatagtagtggatatagtgtgccttttaaaaaacagcttttttttcaagtttaattaacctataataagatctcatatttaaggtgtacaatttgtgacattttgtatatgcatacacctgtgaaatcatcacaattaagatgattaacagggtatagcatttcatgttgttattatttttttgaggcagggtcttgctctgtcatccgtgctggagtgcagtgatgcgatctagactcactgcaactttgaaatcctgggctcaagtgatcctcctaccttagccttctgaatgggtgggagtataggcgcttgccaccatacatggctaattttttttttttttttgagatggagtctcgctctgttgcccaggctggagtgtaatggcgtgatcttggctcactgcaacctctgtctcccgggttcatgagattctccttcctcagcctcccaagtagctgagatcacaggtgcccaccaccatgcctggctaatttttatatttttagtagagatggggtttcaccatgttggctaggctggtgtccaactcctgacctcaaatgatccatcctcctcagccccccaaagtgcttggattacaggcatgagccactgcgtctggcctttttttttttgagacagagtttcactctgtcacccaggctggagtgcaatggcgtgacctcggctcaactcaacctctgcctcctgcgttcaagtgattctcctacctcagcctctcaagcagctgggactatgggtgcccgccaccatgtctggccaatttttttttgtatttttagcagagatgaggtttcaccatgttggccaagctggtcttgaagtctgatctcatgatctgcttgccttggcctcccaaagtgctggtattacaggagtgagccactgtgcctggcccgcctggctattttttaaatttttctgtagagaaatttaaaattcagaagtctcattatattgcttaggctggtcttgaactcctggcatcaagggatcttctcacctcggcctcccaaagtgcggaattaaaggcataagccaccatgcccagcctgacatagcattttaaaatctagcttttagttcctgattccctgtatgaactcaagcagttcacttgacttccaaaccaaggttcacttccttataaaatattctttgaattctttccaggtataaaataatgtgacgttttgtagtccagcttctcactcataccaatggtggactcttggaagtttgcatctaaaaaattatccccttttttgttggacagtttcagagattactttgagaaggagctcatttcattgttaggattaataattgctacaaagtccttttttttttttttgagagacagagtctcgatctgtcacccagtacttttaaaattaattacaaaatcttatattctgtcactttcatgcagtatttctgctaactagagctgtactattcaatatggtagccactagccatgtatggctacttaaattcaaataaagtaaaatagatgaaattgcaaattcagttcctcagtttcactagccacatttcaggtgctcagaagccacatgtagctaacggctaccatctggacaagcagctgtagactgctcaacaacatcagggaaagttgcattgaacaacactgctattgagtactggcttgagttttctaaatgccaatttcataatgtcttttttttttaatgaggaaatttttaattagtcccagttttatctttggccttctatctcctgctgagtttgatatttaatttaataaactcttgagtgcttgctgtgttccagacactgcgctatgtgctgtggatatcagtgaacttagtgagataaggactaaaatacaggtaggacaaacaggtaatgcagagtaaggaatgagggagagaatgtgattgttctgaaccgggaggtcagagaaaccttcacgaagtggctgatacttgcactgaatcttaaagaatggtgggaattttttaggtagagaacttggaaaggacatgtactatgtgcaagagaggcacagagacttggaacatctttgtgaatttgggaattccagtagtttggaatgcctggagcagagtgtgaagggtgtgtgtctcagctgatgaggtttacaggtgggaaggagctagatcacgaggatgctggattttcatctccttggtgatcaccacgaaagggtttttagaatatttgctcactccgaggatattatttgagctgtgataggtgctgggcctataccagtggatgagacacacatggacccctccttggtaaaccttacaaacttgatgtgtgaggttgtagccaaattctacccatcttttaaggccccacccttctgataaggtttgttcaattatccagtctttatgggtttccccctctgctacttttggtcaatggcacacaatttataatcaaactaactgcatattgaatcattcaataatgattgtgtgtcttctcttcttagctacctagctcttcctaccctaccccatttttagggaagaataggacttaaaccttgcagtaagatctagcacaattcttttttttttttttttttgagacggaatcttgctctgttgcccaggctggagtacagtggcacgatttcggctcactgccagccctgcctcccaggttcatgccattctcctgcttcaacctcctgagaagctgggactacaggtgcccaccaccgtgcccggctaattttttgtattttcagtagagacggggtttcactgtgttagccaggatggtctcgatctcctgacctcgtggtctgcccacctcagtgaagttcacgttaggatgcctatgtgccttctgaggtgagacatgtacatcttgacttactctctttgagtccagagaatctcttaaatggaccgtagaaaaacactgtctttcttttttttttttttttttgagacggagtctctctctgtcgcccaagctggagtgcagtggcatgatcttggctcactgcaagctccgcctcctgggttcacgccattctcctgcctcagcctcccgagcagctaggactacaggcgcctgccaccatgcctggctaatttttgtatttttagtagagacggagtttcaccgaaacactttctttttcagacccatttaaatttcagttcacgtaaagacaaaggggtatctgtttcttagctgtaggtgtttctgccagattataggtgatacagtagattgggcttttgtagcatcagctctgcacctttatccttcccctaaaaactttttcatacccctttcccctacaagcttggattcacatcctggcattgccacttaatgaggtgaccagtcagtaagctgagctcaattttcttttctttttaaaatgtaaattaaaaaaaaaatttttttttgagatggagtttcactctttttttgctcaggctggagtgcaatggcactatctcagctcactgcagcctccaccttcggggttcaagtgattctccagcctcagcctcccaagaagctggcattacaggcgcgtgccagcacgcccagctaattttgtatttttggtagagacagggtttcaccatgttggccagactggtctcgatctcctgacctcaggtgatccaccaccttggcctcccaaagtgctgggattatagacatgagccactgcacccggccctatttaaaatttttttttagagactgctctgttgcttaggctggagtgcagtggtgtaataatatctcactgcaacctcaacctcctgtgctcaagagatcctcccacttcgtcctctccagtatctgggactacaggagcgtattaccatgcttggctaatttattgtggagatgtggtcttgctatgttgcccagactggtcttgaattcctggcttcaagtgatcatctcacctcagcctccccaagtgctggaattataggtatgaggctctgtgcccagcctgagctcaattttataatgaattaagtggagataatgtcagcctccaatacatcattgtgagaattaaataacgcaacatgtaaaatacccattcctaggcagagttagatattcagtaaaaataacttctcttttagcttgaatgatgggaaaactgtcatcagcctttgtgttccattcattcattatgtattcattctggtaggctgttttgtgaaatgctggctaacacatattggaaacatttgtgagagatagtttgtcagtgatattatagaagggaattctgtttgggggatcaattggataagggtgcctgttagacacccttgttacttgttacttgtatgtcaactagcctgtctttatatgtagttaattttgacagtcattttatttcagatgctgttttactaggttattatcctccattcttttcatcttagatatttagtgaaataaattagaatctgactgccaagccaatattcacttattccttatttgatgttcatattgtattagatatatggatgtatatctgtttccccttttcttttatttttagagacagggtctcagtctgtcacctagactggaatgcagtggcatgatcataactcactgcagccttgaacttttgggttcaaatgatcctcccgtctcagcctcctgagtacctggaattacaggcatgctccaccatgcctgactaatatttttatttttttgttgagatgagtccactctatgttgctcaggcttgtcttgaactcctggcttcaagcaatctttccacctaggtcttcctaagcacttggattatagcgtgagccacgatgcccagcccctccttttcttttaagggagaaattctacattctctctgaagaaaacttgtaaactgatatcgtcttcatcagatttttggtgttacctctttttttttttttttttttaaggatctcattgaagtacaactctattttttctttatcttaccaatttaatatttggttctaaccagtttctttgatgtgtacattttcacgccataaaaatatgtttaactgttgcagattcatggtactttgtatcaacaccttatgttgccatgtttttaatttttattttattatactttaagttctgggatacatgtgcagaacgtgcaggtttgttaagtaggtatgcacgtgccatggtggtttgctgcatccatcaacctatcatctacattaggtatatctcctaatgctatcctagtcctccaccccacatgatgttctcctccctgtgtccatgtgttctcattgttcagctcctacttatgagtgacaacatgcagtgtttggttttctgttcccgtgttagtttgctgagaatgatggttttcagcttcatccatgtccctgcaaaggacatgaactcatccttttttatagccgtatggtattccatggtgtatatgtgccacattttctttatccagtctatcattgatgggcatttgggttgactccaagtctttgctattgtgaacagtgctgcagtaaacatatgtgtgcatgtgtttttatagcagaatgatttataatcctttgggtgtatacccagtaatgggattgctgggtcaaatggtaattctggttctagatccttgaagaatcgccacactgtgttccacaatggttgaactaatttacattcccaccgacagagtaaaagtgttcctacttctccacatcttctccagcatctgttgtttcctgactttttaatgatcgccattctaactggcatgagatggtatctcattgtggtttggatttgcatttctctaatgaccagtgatgatgagctttttttcatatgtttattggcttcataaatgtcttttgttgagaaatgtctgctcatatctttcaacccaaatgcccatcaatgatagactggataaagaaaatgtggcacatatacaccatggaataccatgcggctataaaaaaggatgagttcatgtcctttgcagggacatggatgaagctggaaaccatcattctcagcaaactaacacaggaacagaaaaccgaacactgcatgttctcactcataagtgggagttgaacaatgagaacacatggacacagggaggggaacatcatggggggtgggggactaggggacactttttgatggagttgtgtttttcttgtaaatttgtttaagttctttgtagattctggatattagccctttgttagatgggtagattgcaaaacttttctcccattctgtaggttgcctgttcactctgatgatagtttcttttgctatacagaagctctttagtttaattagatctcatttgtcaattttggctttcgttgccattgcttttggtgttttagacatgaagtctttgcccatgcctatgtcctgaatggtattgcctaggttttcttctaggatttttatggttttaggtcttacgtttaagtctttaatccatcttgagttaatttttgtataaggtgtaaggaaggggtccagtttcagttttctgcatatggctagccagttttcccaacaccatttattaaatagggaatcctttccctgttgcttgtttttgtcatgtttgtcaaagatcaaatgattgtagatgtttggcgttatttctgaggcctctactctgtttcattggtctatatatctgttttgataccagtacaatgctgttttggttactgtagccttgcagtatagtttgaagtcaggtagtgtgatgcctccagctttgttctttttgcttaggattgtcttggctatacgggctctttttggttccatatgaagtttaaagtagtttttgtctaattctgtgaagaaagtcaatggtagcttgatggggatagcattgaatctataaattactttgggcaatatggccattttcaccatattgattcttcctatccatgagcatggaatgtttttccatttgtttgtgccctctcttatttccttgagcagtggtttgtagttctccttgaagaggtcctttacatcccttgtaggttgtgttcctaggtattttattctctttgtagcaattttgaatgggagttcactcatgatttggctctccatttgtctgttattggtgtataggaatatgtgatttttgtagattgattttgtatcctgagactttgctgaagttgcttatcagcttaaggagattttgggctgagacgatggggttttctaaatatacgataatgtcatgtgcaaacagagacaatttgacttcctctcttcctatttgaataccctttatttctttctcttgactgattgccctggccagtacttccaacactatgttgaataggaatggtgagggagggcatccttgtcttgtgccagtgttcagaggaaatgcttccagcttttgcccattcagtatgatattggctgtgggtttgtcataaatatctcttactattttgagatccgttccatcaatacctagtttattgagagtttttagcatgaagggctgtttaagtttactgaaggccttttctgcatctattgagataatcttatggtttttgtcacggttctgtttatgtgatggattatgtttattaatttgcatatgttgaaccagccttgcatcctggggatgaagccaacttcattgtggtggataagctttttgatgtgctgctggattcagtttgccagtattttattgaggatttttgcatcaatgttcatcagggatattggcctgaaattttcttttttttgttgtgtctctgccaggttttggtatcaggatgatgctggcctcataaaatgagttagggaggagtccctctttttctattgattggaatagtttcagaaggaatggtaccagctcctctttgtacctctggtagaattcggctgtgaatctgtctggtcctgggctttttttggttggtaggctataaattactgcctcaatttcagaacttgctattggtctattcagggatttgacttcttcctggtttagtcttgggagggtgtatgcatccaggaatgtatccatttcttctagattttctagtttatttgcatagaggtttttatagtattctctgatggtagtttgtatttctgtgggatcagtggtgatatcccctttatcattttttagtgcacctatttgattcttctctcttttcttctttattagtctggctagcggtctatctactttgttaaccttttcaaaaaaccagctcttggattcatttgtttatttttttttggaagggttttttgtgtctctatctccttcagttctgctgtgattttagatatttcttgccttctgctagcctttgaatttgtttgctcttgcttctctagttctttcaattgtgatgttagggtgtcgattttagacctttcctgctttctcctatgagcatttagtgttataaatttctctctgaacactgctttagctgtgtccagagattctttgtttacactgtgtggggaaaaccacctactgaagcctcactaatggtggacgcccctgtccccaccaagctcgagtgtcccaggttgaccagactgctgtgctggcagtgagaatttcaagccagtggatcatagcttgctgggcttcatgggggtgggatcagctgagctagaccacttggttccctggcttcaggcccctttccaggggagtgaatggttctatcttgctggtattccaggagccattggggtatgaaaaaacttctgcagctagctttgtgtctgcccaaacggctgcccagttttgtgcttgaaacccagggccctggtggtgtaggcacccgagggaatctcctggcctgcaggttgagaagacgggaaaagcttagtatctgggtcagaatgcaccatttctcatggcacagtccctcaggacttcccttggctaggagagagagttccacgaccccttgtgcttcccgggtgatcgcctcgccctgctttggcccgccctccatgggctgcacccactgtctaaccagtcccagtgagatgagcctggtacctcagttggaaatgcagaaatcacctgccttctgccttgatttcgctgggagctggagacgggagctgttcctattggccatcttgacagccaccccctatttatgtatgtatgtatgtatgtatgtatgtatgtatgtatgtatgtatttatttatttatttatttggagacgggttcttgctctgtcgctcaggctggagtgcagtggtgcgatctcagctcactacaatctctgcctcttgggttgaagcgattctcctgcctcagcctcctgagtagctgggactacaggcgcatgccactatgcccggctaatttttgtatctttagtagagatggggtttcaccatgttggtcaggctggtctcgaactcctgaccttgtgatccgcccacctcggcctcgcaaggtacagggattacaggcgtgagccactgcgcccgtccccccactattttttttttttggcattgttaagacaaacccgctgagaaagagcaaggttatgaatcatatctcccaggattgtgtggaataaaggagatagtgtacataatgtccttagctcatgtctggagcatataagtgctcagataatgctggctggtaactattagtgttactgtattcctcaggtcttatgtttaaaattatttaacaacagagactatgtactatatactttatgtattatagactctattttacacattaatatatttttcttctcatcataacttttaatgttttatcttttgtcttgcagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtaagacttattttttgtggataattgattttatttttatgataaaactatatacattggcagtttgtattgtatgttggtattagattttctatatcctatttgctttacaaaagtagactttaaaggttttatttacaaatttatagtttataacaaatttgaaatgatatattttccttatttctagagttttccatttattgcgctgatctgtttagccgtgttagtaatagatagcagccaggcagtacacaaacacacttttgagcctttgggggatgggcccataggggtgtttcctgaccaagtttggcctctctgcattgccctttcttgtaaatacccacctattctttccatcttgctttttttttttttttgagaccgagtctcgctctgtcgcccaggctggagtgcagtggcgtgatcttggctcactgcaaccttggcctcctgggttcaagcaattctcctgcctgagcctccctagtagctaggattacgggtgcccaccaccacgcctggctaattttttttattttttttttgtatttttagtagggatgtggtttcaccatgttggccaggctggttttgaattcctgacctcaagtgatccgcccgccttggcctcccgaagtgctgggactacaggtgtgagccaccacgcccagcccacattctgtgcttcttagagagctagttctatcagtaaaatccttccaatatattatgaataaatatgattttgtgggcttgtcttggatcttagctaccttttgttacattgtgtgtgtgggcaaaattgtttaatatccagcttataacttggaacactggccaagtataagttggaacaatggccatgtgtaagttgtctgtatatgaaaatgtatgtaatgtatcttgtgaggttagtttcagaagttatgtttttaaatattttgattctaggaggcttttttgggactattgatgccataatacttaattgttggtatatttactagctagttcttcatattttgttttctaagttagagttgaagaacttagaaatacaaatgtgatgttcacaaatatgagaatcaggttattctttttttccactcatctatagccttcctataaaaaataaactgtgacaggtgctgtgactcatgcctgtaatcccagcactttgggaggctgaggcgggcagatcatgaggtcaggagatcgagaccatcctggccaacatggcaaaacccgcctcactaaaaatacaaaaattagctgggtgtggtggtgcatgcctgtaatcccagctactctggaggctgaggcaggagatttgcttgaaccagggagtcggaggttgcagtgagctgagatcgcaccactgcactatagcctggcaacagagcaggactccatctcataaaaaataaaataaaataaaataaaaaagtaagctgtatcaaacaatttcagtggctatcttcagcataacatatttaaaaggttaatgtatgacttagagccagactcataacaggataaaatccagactttctagactggtctttgtaatcaaggatctttgtaatctgaccttgtccagagagtggatgttggaacttttgcttttcttaaagtggtttgaaaacagctattctgcagtaagttatttcagagacataatgaaaaaattttggtcttacatgaagtcagatagtgtaataaactgttgatatagaaccaaaagatcctggctttaagctctggttctgatgctgagaagccctgtgatcatgaacaaatgactgtattctttagaacttttgtttctgtcatctgtgaaaaagagataataatagttcttctacctacaacactcaatgtgttactttttttttttttttttaaagggtggtagtttgatgcaaaaattagtatgtggactgtagtggcagaaatcctgggtttgagtcctggtaccagagcttgttggctttctaattttataagtcatttaaaacctgaggctgggcctcaggactttcttatgtgaaatggagaaaataccttgtaaactctaaagcactctgaaaatattactcttcatgactgtacagtagatctcatgggtaagtcagtagatataattttattgttttttcaggtgctttgggaaaaagaacacggttccaggaaaattatgtggcacaactgattctagatgtaagaagggaaggggatgtcctttcaaattgtgaattcactccagcacccactcctcaggaacatttaaccaaggcaagtaggacattaagttattaaattcaattaacacctgagtctaagaatttcaatagctgagtaccatagaaacactgaatgggttggggacagacttcattttattctttcttttgccttttaaaggttgctgagtcagggagaactggtgtttaactggtgtttttttttcctaacctgtgatagaaaaaactggtgttttttttttcctaacctgtatatagagataaatactgtttttcttctaggattcaataactatgaattaatgatgcagttagttatgtattacccctcttgaagaaatacgaaaggcagactgggtgtagaccagtttctctatctgctatcatatttgtttccttatgtttgtcttctcttggaatctcttaggctttttctaaatatataaacattatcagaattccttttcactagttttgtgatcggccttttgtttctctgtcattattgggggggtggttgccttagtatgtttatttgacatgtctagtgaattctcttctttagtttgaattatgactcttggtcagtttacctaattatagtccactccagctgcttccatgaagccgtttagtatttatgcatgtgttttctgatcccagaaacccccaactacttttttttttttttttttttgagatggagtctcactctattgcccaggctggagtgtagtggcgtaatctcggctcaatgcatcctccgcctcctgggtttaagcgattctcctgcctcagcctcccgagtagctgggattacaggcatgcaccaccacgcccggctaattttgtatttttggtagagacagggtttctccatgttggtcaggctggtctcgaactcgcaacctcaggtgatccacccgtctcggcctcccaaagtgctgggattacaggcgtgagccaccacacctggctgtgtttgttgttttttaatgtggagttgttctatagaaaagtatctcccagtgattgacctggcatggtggctcatgcctgtaatcccagcactttgggaggctgaagtgggtggatcacttgaggtcaggagttcgagcccagtctgaccaaaatggtgaaaccctgtctctattaaaaatacaaaattaggccaggtgcagtggctcacgcctgtaatcccagcactttgggaggccaaggtgggtgcacgaggtcaggagattgagaccatcctggctaacatggtgaaaccccgtctctattaaaaatacaaaaaaaaaaaattaaccgggcgtggtggcgggtgcctgtagtcccagctactcaggaggctgaggcaggagaatggcgtgaatctgggagacggagcttgcagtgagccgagatcatgccactgcactccagcctgggtgacagagcaagactccgtctcaaaaaaaagaaaataaacaaaaaaacaaaattagccagttgtggtggtgtgtgcctgtaatcccagctacttgggaggttgaggcaggagaattgcttgaacccaggaggtggaggctacaatgagcaatgagtgcaattgcatcattgaactccagcctgggcaacaagagcaaaactccctttgaaaaaaaaaaaaaagaaaagaaaattatctcctggtgataaataggatatgatgagtattatgagaaatgtatgaaaatgatgtaccatttaatacagaattttaatcgtttttttgcttgttctttcttttcttttctccttttcttctttcttcccttcctccctccctccctccctccctcccttccttccttccttccttccttccttccttccatttttaaatggagatgagttctcactatattgcccaggtttgtttcaaactcctgggctcaagcaatcttcttgcctcaacctcccaaagtgctgggattcaccatgtaatacatgttacagggttaatgtggttaacatttttaatatattacatgtggctatcagaaattttttcagaattattttattttaaaaattttggctgggcgtggtggctcacgcctgtaatcccagcactttgggaggccgaggtggacggatcatgaggtcaggagatggagaccatcctggctaacacagtgaaaccccgtctctactaaaaatacaaagaattagctgggagtggtggcaggcgcctgtagtcccagctactccggagtctgtggcaggagaatggcgtgaacccgggaggcggagcttgcagtgagctgagatcgtgccactgcactccaggctgggcgacagagtgagactccatctcaaaaaaaaaaataaatcaataaataaaaaataaattttacctgtttatctatttagagaccaggttatgagactggctaatttttgtatttttggtagagatggggtttcaccgtgttgcccaggctggtctcgaacttctgggctcaagccatccactttcctcagcctcccaaaactgttgggattataggcatgagccactgcaccggccagaatttaatcttttgtatgtgaaataaaatacattcagataatcttatggtctttgttaattactacttgaagatggagagtacaagttgtatgctgtaggtatggattagatagaaacatagctttattctaatgggtggaagagaattgttaagttggttatatatcatattaccttgtgttaaacacattattagattgtaatatacaccatctgtttaataaccatttttcaggaaaaggaaaggaacactactataccatttatagtgattacaaaacatatcctgattggaaatgttacaacatggcccggtgtggtggctcacgcctgtagtcccagcactttgggaggccgaggtgggaggatcacttgaggtcaggagttcgagaccaacctggccaacatgccgaaaccccatctctgctaaaaatagaaaagattatccgggcgtggtggtgtgtgcctgtaattccagctacttgggaggctgaggcaggagaatcgcctgaacccaggaggtggaggttgcagtgagccgagatcatgctactgcactccagcctaggtgactaagtgagactttctcaaaaaaaaaaaaaaaaaagaaaagaaagaaatgttacaatgtgaaaatatgtattttaatttttttattttttattttttttgagatggtgtctcattctgtagcctgccttagcctccgagtagctgagactacagccacatgccaccacgcccggatagttgttgtatttttagtagagacgaggcttcaccatgctggccaggctggtctcgaacttctgacgtcgggtgatccgcccgcctcagcctctcaaagtgctgggattacaggcatgagccaccgcacctggcttctgtctagcttcatttggctcctaaagtcctctttttttgttgttgttgaattagaaaaaaatttaacccaagattattgaggaataatttatataaaatataccgattttaaattacactttgttgagatttaacaattagacgcgtgtcaccaccaccacaatgaaaaaaagtttctccaaagagtgccgccatagttctttgcagtcagtcagttgctgtcatagattagatctgtcttttctagaatttccaataaatggaatcatacagtgtataatcttttggtctggcttaatggtttcaagattcatccatgttgaaataccaatatgaactgttggtggacatttaagttatttctagcaggtattactaataaacctgcctagaaaatatgtatgtaagtctttgtgtgaacgtaagtttttttttttctcttctttttttatttttgaaatggaatctcgctctattgcccaggctggagtgcagtggcatgatctcagcttactgcaacctccacctcccgggttcaagtgattctcctgcctcagcctcccgagtagctgggagtacaggtatacgccaccatgcctggctaatttttgtatttttggtagagacggggtttttgccatgtttgccaggctggtctcgaactcctgacctcaagtgatccacccaccttggcctcctaaagtgctggtattacaggcgtgagccaccatgcctggcctctcttgcccatttttaatttgagttgtttgtcttcttattgagttctaagagttctccatattctggatgcaagtcccttttcagatatatgttttgtcagtatatttggatctggagcttgactttttgtcttaacaatgttttcagagaacagaagtttttaatttgatgaagtctaatttatgaagtttttctcttataattcatactttttgtatcctaattaaggactgactgcctttccatctcagggttacaaagttttttttaatgttttcttctagaagtttttttagctttagcttgtatattaaggtctgtgattaattttgatttaatttttgtgtatgattgagataaacgtgaagggtcatttttttttccaaatggatatccagttgttctgacatcattcattcacttacttattttttggagagacagggtcttgctgtgttactcaggctgatctcaaactcctggcctcaagcttcctcccaccttggcctcccaaagttctctaatttcatttattgaaaggctttacctgttgaaacacctaggtagctatattgaaaatcaatccatcatatatgcatgggtctaaaattttgaactgtattctattccattcactttatatgtctgtctttatgccagtactatactgtctgggctttatagtaattcttgaaatcaagtacttcctcatattttattcttttaaaaattgttttggttattgtcgatcatttgcatttccatataaattttagaatgagcttgtcacagtttggcatttccatcattgataacaagctatttgtgagaaatttctcaactgatcacactatattgctgagacacagagttgggaagttgatgtttttgattagaatttagaggcagaatagaaagatccagttttgaatcctgatgctatcacatactttgagtgtgatcttggatgagcttcaagtatctgattctttgttttttcatcagtaaataaggatagaaatgcctattgtctatgattgttgtgaggaagaatttgaaaaatgtatataaaattatctgcagaggggcttttgcatacttggctcaatcagtgatagctgttattccctattattgtcattgttagtgcattcttgaggtatagatggcacatctttcatttctggaaggtaaattgtttccaaatatgtgtttcacaagaaatagcctattgaccatatgtcaaacaggtaagttaactttatcctttctagcaatctattacatgccattctggtgaatgaataaaatttaatttttggtctaagtattttcttttgtattctactagaatcttgagctcaatgatgacaccattctgaatgacataaagttagcagattgtgaacagttccagatgccggatctgtgtgctgaagagatcgctattattcttggaatctggtgagttaatgactgacttggctgctttgaacactttgcatattgattctcttatgtgtggagaatctttattcaaggaggttccaagagttctggatgaatagggaattttgtagtgcttatgaagatcagaggaaatacttggagaaccaattaaagggttagatattacaaatctccaatgagttgatatatctattcttctgtttcctttataagcacaatttctttggttagctttagctaggaatagattattaataaaatattaaagacaaatgagaatgactattttgagatttgaggatatttacatttcaaaggataggattattttttaatactgtggaaccttatctatggtggaaatagttttaacttttttttctgattagaaataatttcaaatttgtgaaaaatgtttaagggcaggacaatacatataacttctaagaataagtttccaagatgatgctgtatcattcctgaataatttagtgtatatttccaacaaataatgttatttttgtacatagtcacaatacagctatcaaaatcagaaaattaatgttggtactttgctatcatttaattctcagaccccattcaaattttgctagttgttcagatactctcttttagaaaagatccagtctagaatatatgtattacatttagttttcttgtctctttagtctttgtcagtctggaatagttcctcatttttgcttgacttgcatgatcttgacacttgaaatttacaagtccattacttttagactttccttcaatttgagtttgtctgattttttttttttaatagttggattcaccttatgcatttttttttttttcctaagatggagttttgctattgttgcctaggctggagtgcaatggcacaatcttggctcattgcaacctccgccccacgggctcaagcgattctcttgcctcagcctcctgagtagctgggattacaggcgcacaccaccatgcccggctaatttttttgtatttttagtagagatggggtttcgccgtgctttccaggctggtctcgaactcctgacctcagctgatccgcccgcctcggcctcccagagtgctgggattacaggcatgagccaccacacccggccaccttatgcgtttttagctgggatgtcagagaaatgaagttttgttattctcattgcatcctagcaggtagaatatgatttgggtttgccccactactggtgatgttaacttcaatcacatgattaaagtggtgtttgctaggcttctccaaagttattcatttattttgtaattaacattttattgaccaggtgcggtgtcttatgcctgtaatgccagcactttgggaagccgaagcggatggatcacccaaggtcaggagtttgagaccaggctggccaacatggtgaaatcctgtctctactaaaaatacaaaaattagctgggtgtggtggcaggcgcctgtaatcccagctacttggaagcctgagacagaatcgcttgaaccgagagattgcagtgagctgagatcacgccactgcactccacctgggtgacagagtgaaactctgtctcaaaaaaatacaaattctttgaaaggtaattttagactaaatgaatatcccatttgtcatcaagagatttattaatattcaaaatagaatccctcacaaagctataatattgataccagttaaattagtaatggacaacttaagaaagggaacatttgaaaaaatcttgttcttttttttttttttgagacagagtcttgcactgtcgcccaggctggagtgcagtggcgcgatctcggctcactgcaacctccgcctcccaggttcaagcaattctcctgcttcagcctcccaagtagctaggattacaggcatgtgccaccacacctggctaatttttgtatttttagtagagacggggttttgccatgttgaccaggctggtcttgaactcctgacctcaggtgatccgcccgcctcagcctcccaaagtgctgggattatgagggtgagccaccgtgcccagtcaaaatcttattcttttaattcagtagaactcaccctttggtgttcaccttatagcattttacttcatatatgcaatagtaagttttcttttatataaaagttgaattcagttctacagttcctttttattttaaaatggatcacacatacagagttctgtttctaaagccaaagcaattttcctgtaacattatttattccagtgacagaatttttttttttttttgagacagagtctcgctgtgtcaccccaggctggagtgcagtggcgcgatctcggctcactgcaagctccaccttctgggttcatgccattcttctgcgtcagcctcctgagtagctgggactacaggcgcccaccaccacagctggctaattttgttttatgtatttggtagatatggggtttcactgtgttagccaggatggtcttgatctcctgacctcgtaatccgcccacctcggcctcccaaagtgctgggattacaggcgtgagccaccgcacttggccctccagtgacagaatttatgtttactgcataaaaaatacttgttcaatccataacaacatttagtatgttaataatatgaatagcaaccatttatcaacaatagtatgtggtaggcattataccatgtactttcacattaaccctcattaatagtctaacaacaccaagcgttgttatttttctcaattcttcaggtgggaaaacaaggctcaaatagctaaatgacttcttcagaattacagagtggcaattaggatgtgaatctaagttttactgaccccaaattctgagttcttctttatgttacttaagaaaatgttattttggcaagttcataattgtcatctcatcaggaaattaaactatgccaaataaatgtattcccaggcattatgtcagctgaactatagctatattgaggtaaactttacatttaagagaggactaaaaatccagaaaatgctcatcttttctggatacttgtttttcccaaaggaagatctcagtggaatttcaatatatagagcagataaaagcacagaattgatttcaccggcagtttaactcttcattgtttggtagaaaccacttgcttattttctgaatcttagtgcatctgatgcagtttataaacctgtggttagaatagtaatgaatttatgatttgcatgtactaagttactgtggggtttttaaatagtgattttcttatattggctgatctctgtctgatccctgtggtcgctaacccccatgaagaggtgacttagacattgtgttaggctgggttggtttggaaaggagacttagagaaggtgaattcttttttttttgttttgtttttttgagacggagtttcactcttgttggccaggctagagtacaatggtgcaatcttgactcactgcaacctccgactcccaggttcaagcgattttcttgcctcagcctcctgagtagctgggattacaggcgcccaccaccatgctcatctaatttttgtatttttagtagagacagggtttcaccatgttggccaagctggtctcgaactcctgatctcaggtgatctacccgcctcagcctcccaaagtgctgggattacagctgtgagccactgtgcctagcctgagaaggtgaattcttatacattgtagattggtacaacagtggggatagcttcaggctccttccctagactcttgctgttcactggcctcctgcttgagttggatttttacctgacgaccaaatgctggaacttgccccacctctcttatacctcattctacctgaggtatgaatgcttgtatgcattcatgtgtgtttgtcttgtaggtgtttttaataaaatcatttcatagttctttcctcttcccttcattgattttttttcttttccaacaataaaaatcggttcatttaaaaattattatataaacaatttatggtcattataaaatccttaaacagtattgaaaattatagggatatgttatattttataagacagtgttttcttttcattctgtttttttttttttttggagatggattcttgctctgttgcccaggctggagtgcagtggcacgatcttggctcactgcaacctctgcgtcctgggttcaagcagttctctgcctcagtctcctgagtagctgggattataggcacttggcaccatgcccagctaatttttgtagttttagtagagacggggtttcaccatcttggccaggctggtcttgaactcctaacctcgtgatccacctgccttggcctccataagtgctggcattatacgcattagccactgcgcctagcctcttttcattcttaatatatgaaatatttatatacatttatatgccctttaaaatttgttaaattaatatatggaatatttggaattacattccatatatatatccacttatatatattccatatatattattattatatgtggaatgtttcatatattaagaatatttaatattccatttggaatagtctaataataaaaagaactctggtgaaaagttaactgttatgctgaatctaatgtttgtcattttcttgccttttaaaaaaaattttaatttcatgttttgtatgcttgtaagtcagttgcttaaatttgcttgtttttgagctttataaaagtggtatcttataataaatatatagtcctctgtgatttgcttgttttctctcattattgtattcctgtgatgcatgttgttatatgtagctgcaatttactttgcagtatagcattctgttggatgaatatacaacaatttgtcgttttccttttgggcatggattgtttccagatttttcctattatacacaatattgctatggatatttatgtatctcattcttgatatatctgttcaagaattcctctggtctctctatctaggatggaagtactgagtcgaggatatgtgaatgttcacaaagaatagtgccaaactgttttcttctttttttttgagatggagtcttgctctgtcactcaggctggagtgcaatggcgcaatcttggctcactgcaacctccgcctcacaagttcaagcaatcctcctgcctcagcctcccaagtagctgggactacaggcgtgcgccaccacccccagttaattttttgtatttttagtagagatgtggttttaccatgttggccaggatggtctcgatctcttgacctcatgattcattcgcctgcctcagcctcccaaagtgctgggattacaggcatgagccaccgtgcccggcccaaattgttttctaaaatgatcctaccaataatgtaattgatcctggatcagcaagatctaagaatgcccattgttctgcctccttgacagctgttataaaaacatttttatttttttggcatgagtttaataaataagacttggtgtcataataattcttttcattttctttgctgagtggcacatattgaatttcttttttcctaggagggtaaattatgttggctgcacagtggcccatgcctgtaatccaaacacattgggaatctgcggtgggcaatcacttgagcccaggagttcaagaccagcctggacaacacagtgaaactccatttctacaaaaatagaaaaattagctgggaatggtggcgtacgcctgtagtcccagttactcaggaggctgagctgggaggatcccttgaactcaggaggtggaggttgcaatgagccaagtgtgtgccactgcactgcagcctgggtgacacagtgagccctgtctcaaaaaaaaaaaaaaaaaaaagataaattatgttgacatttagtacaccaatcgcattttatttgtcagcattttatttttatacctttatactttataccttatatctttgacaaactctacatttgtatataatgccatagtatttatttatttatttattttttaattttttgttttgttttgtttttttgaaacagagtctcgctctgttgcccaggctggagtgcagtgtcgcgatctcggctcactgcaagctccgcctcccgggttcacgccattctcctgcctcagcctcccgagtagctgggactacaggtacttgccaccacggcaggctaattttttgtatttttagtagagacagggtttcaccttgttagccaggatggtcttgatctcctgaccttgtgatctgcccgcctcggcctcccaaagtgttgggatcacaggtgtgagccactgtgcccggcccccataatatttaaatatctgctttcaaatatataaaatatagcagtttactttgctttttaaaaattatatttcattagctacaacatgcatcttataattaatttacctttttttcttaatttaaagcactaattttcaaaagaataacccagtgcacacattaactgaagtggagcttctggcatttacatcagtgagtaatgtctttttctcttccatttcatttttttcctggtaaattacttcctctggtatggtcttgccttggattgtttatgttgaaacactgccacctaaggaaataaggtggagaaaaatcttaccactgtagtttctaagtcacatgtatcttgctgctgatttaagagtctgcaactcttaaattgagtgctatgcctacatggtcatggtgaaaaagaaagctaggagcaggaccaggagaccatgggttaaaaagatgtcaagagcatggtgtgctcatcagtgttcaacagtctagagcagtccggagataaatgtggacagagaagagaccactggattggacaattaggagtgcattggttacttctaggacagtttcagtggactctctggacagttccctcattacagagaattcagagggaatatggtgtaaggaaataaagttaatagataaagatcacagttggagaagaatagcagtgaaaaggaaagctggagtaatagatatttgaggattttagatcaagaagggcttttaagaagagaaaagtcacagacgaaggggtcagtcagtatattttggctttatggagaaaggaagatacatatgttctttaatgaatacaagttgcttaagatatatcattttttcaaaggcattttcattatcttagttgggaatccatttagaattctgttgttttcttcctttgttatttttcagataaggcaaaataaaatacttttactggctagaaagaaaagctagattgtggttgggcgaggtggctcatgcctgtaatcccagcactttgagaggccgaggcaggtggatcacttgagatcaggggttcggaccagcctggccgacatgatgaaaccctgtctctaccaaaaatacaaaaattacctgggcttggtggtacatgtctgtaaccccagctactctagaagctgagaaggagaaccacctcaacccggaaggcggaggttgcagtgagccacactgcacttcagcctgggtgacagagagcaagactccgcctcaaacacaaaacaaaacaaaacacaacaaaacaaaaaaagctagcttattttgtactgtaatataaatttttcacgttactatttcctacataccctgtttgaactggttaggtgttaagtcgtttgagtcctctggttgtgtgttttattttcccacttcagtattctcagaaatctttggtgtgtatcatcatattatgtgtgttttaggtaactgtggaaatgttcctcattatttattatatgtgctataaaggaattgacgaagtgttaacaaattttaaagggcatataaaaaacatattatgtacttttcatttattcattcagctaatatatatctactaaataatatatacgggtattgtactagtcattggggatttagcagtaaataaagccttttttgttctggagtttatgtcaaatacagagtagacaaagagagaaccagctatttcacagaagtgctgaggagaaatataaagcaggttaagagactaagaatgggatgggcgcagctgttttagacaaggtggtcagggaaggtctcagtgggagggtgacactgaacatagatctgtgtgaaatgagggatgggggaaggctagggaaggtctggaatggctgtgagcttgagtcagggtagggactggatggggacaagtgtctaggtgatgaatggtgacctggatgcttggctttctctgatgatggaagtaaacagcgatgtggcatatgacaggaaatgtttctgctggccagtagtaacagtttcttgggattggtccataagcagtttattgcagcatatatattaccacagttatcctgaagacactagcacactctttttacattcaaacagttaattttttagcatttcttgtgtgtgtggcgggggttccctttctttaaaacttttcctttctttaacctattctccttcccttgcactgtgaggtacctgtgaagtaattagtaacttctgatggtgggtaactcatcattcctagcttgcagtgaaggtcataaattcaggttttgtgcttctccgctcaggcctttatgctgtgtgatttttctgctttcctcccaccctcttacaatcagaaccatcctgaagaccgacctctttttggaggaaagctgtttgattacaatgactcacagtgcttggcctaactcttctaaagagatgagttaatcccgagtaaatctttaattggagaagtagggcaagaaacttctatgtgaggaggacttttaagagccccacacatactttgggctttgcactgtctccccgacatttttttaatctcaaatgaaacatacaaaataaaccagaaaaacttgtcagcccttgtcagctcttcatctatcagttcttcctcctgtcccttctttgtgcatgataccgaagtggataagatgatgaattaaaagtggtccctggtttcaatgaagaaagaaactttatttaaatcctatgtaactccaaaagagtacaaacagcccccaacttatgaaagtttggcgattttttgaatttgcaatggtgtgcaaatgatattcaagtagaaaccatactttgaatacctatacgaccattctgtttttcactttctgtacagtattcagtaaattatatgagatattcagcttttttttttttttttataaaataggctcagtgttagatgatgtttcccaactgtaggctaacgtatttaaggcaggctaagttaagctatgatgtttggtaggacaggtgttattaaatgcattttgacttaggacatttacaactcatgatggatttatcaggatgtaactccatcatatgttgaggagcatttgtatctgagacaagagggactacttctaggtgctaccccacttcttctgagctcttgaacttttatttgtgcctctctttttgcaaggttcatattttggcttatattataattatttatatatatgtatatatatgtgtgtgtgtgtgtgtgtgtgtgtgtgtgtgtgtgtgtgtgtgtgtatgtcttttccttacaagactataaactcagttttagagactgggctctgttcttttctaggctctctacaagggttgtgacagtgcttcaatgctttactcatagttgttgtgaataaatgcatgcagaataagaaaatgaatgaaatatatatcctacaccctggaatagggttgatgtctattcaagagctgtgtcacttacttggttccataatttaggtagtactgcatgatactaggaataaccatctgtttcatctttctcttccgtaaaatgggggaaagagaaaatgcccctatcccaacacagaagactttacttgaggatcatattgcagaacatctatgaaagtactccagagtaggtggaggctggtacactcatagcattcagtgatgctagtttgtagtaaagcattcttattttcaagcaggctaaatggataagatctgcttggaattggccatagatgtggaagagaagggaacagagaggaaagaaacagcatgggtttttcttgctgcgcatccatttccctgctctagcagcagcttggtggcctgggactagggttgtgaactattgaggctacaagatgtcttcctctgttgatagaagagcaaatataatagaagtctttttttttttttttttgaaatggagttttgctcttgtcgcccaggctggaatgcaatggcgcgatctcaactcattgcagcctccacctcctgggttcaagcgattctcctgcctcagcttcccgagtagctgggactacaggcatgggccaccacacccggataatttttattgttgtttttttttttttttttttttttgagacagagtcttgctgtgtcaccccagactgaagtgcagtggcgcgatctcggctcactgcaagctccgcctcccgggttcatgccattctcctgcctcagcctcctgagtagctgggactacaggtgcccaccaccacacctggctaatttttttgtgtttttcagtaaagatggggtttcactgtgttagctaggatggtctcgatctcctgacctcgtgatctacctgcctcggcctcccaaagtgctgggattacaggcatgagccactgcaccaggccaatttttgtatttttagtagagatggggtttcactatgttggccaggctagtctcgaactcctgacctcaggtgatgcacccacccagcctcccaaagtgctggatttacaggggtgagccaccgcgcccggccaatagaagtcttaatactcctaccagaagtctgtaagcacttggagagacagggacagtggttatttggtgtttggtaaatatttattgaataaataaatgaatggctcttggtcctgaattttgttccgttttgattaactgtcccaaagtttactagaatgatggtgaaatctcttttttggagaaatttttgccagtgttttcattttggtgcagcaggttgaaatatatatgaaatatgctgggaaaatgttttaatttagcaaagtcagaaacttgtcctaagaggaatagctttacttgtttaaggttgctgttatgtgatgctatttctgagatattatatctgcatgttgcaggaaagctgagtcagagtaaaaataacccatattgttttagagagccatttatgttgtatcagcttgataacttaaaattagctgtgttatctacattatttcccttcagatgagccacgtcatgacatttagtaatgtttttaatttccttttattgttgaaaatgggaacagtttagttaattcatacaggtttttcagttttccttggcaaaagtttgtttaggctgggtggggtagctcatgcctgtaatcccagcactttgggaggccaaggtgggcagatcacaaggtcagtagtttgtgacccgcctggccaacatggtgaaaccctgtctctgctaaaaaaaaatacaaaaattagctgggcgtggtggtgctcgcctataatcccagctactcaggaggctgatgcaggataattgcttgaacccgggaggcggaagttgcagtgagttgaggtcacgccactgcaccccaggctgcacgacagagtgagactctgactcggggggaaaaaagtttgtttggttttttgttcttgcgatagtttactgagaatgatgatttccaatttcatccatgtccctacaaaggacatgaactcatcattttttatggctgcatagtatgccatggtgtatatgtgccacattttcttaatccagtctatcattgttggacatttgggttggttccaagtctttgctattgtgaataatgccgcaataaacatacgtgtgcatgtgtctaaaacttaaagtataataataataaatttaaaaaaacaagtttcaaaaaaaaaaaagtttgtttaagtgagtgtgaattgatactggcagcttgccttttgactctgcctgaagcccctaggtctctgtaaatgaaagaaggaaaaagatctttggaagttacacattatattttatgtattttctttttctgctattgactttaaagctatttaataaatacttatctatgatcataacatagtttgctaatccgttttatagatgaaaatgattacccatttttcttctagggaattactcatttcttaattgtaatttattaagataggcaatataactattagtgcttgtacttttgatagttttattactagagttgattacttcagaattacctcacagtatagaggaacaagcacagtgagacttaagcaaaataaaacgaacaaaactgtacttacacatgtcatagtcagcctggtgaaaagaaaacataaacagaatgtcttgacagcaaccaaaaaaaaaaaaaagacattaaataagaggaaacaacaactgcaaataccttcaccttctcgttgaaactaattgctctgctttgccttttccttttttttttttttttttttttaattttattattagatggagtcttgctctgtcccccagggtggagtgcaatggcgcaatcttggctcgctgcaacccctgcctcccggttcaagtgattctcctgcctcagcctcctgagtagctgggattacaggcacgcaccaccatgcccagctaatttttgtgtttttagtacagatggggtttcaccatgttggccaggctgttcttgaactcctgacctcaggtgatctgcacttcttggcctcccgaagtgctgggattgcaggcatgagccactgcgcccagcctgcctgttcgttaagttatcttgcaaattagaaatgacctggggactgaccgctttttttttgtcttctacagttaaccatgtcttgaggttaatgcttattagaatttcccttctggcccactgttactggactttaatttccattgtcaacaactataaaattggataaaatatatgaaacagtaatgtataaaaaggataatatatcatgaccaaatagtgtttatcccaggaatacaaaattggtttaatatgaaacaatgcagttcaccttattaatagagcaaaggagaaaaaccaaatgattatcttaatagaaacaaaaaagcctttgacaaaattcaacacctttcattataaaaactcttagtaaactaggaatagaagagaatatcaacctgattaagtgcatctagctaaaatcattattggtgaaaagtagtctttcccccttaagctcagaaaaaagggaagattgtctgctttcttcacttgtcttctagttgaactagaatcctagtagtgcaatagataagaagaagatatgaagaaataaaaggtatatagattggaaattaggatataaactacctttatgcagaggtgacatgtttatgtcatagaaaaactcttaagaatgaacatgaaagctactagaactaacaagcaagttcttagaatacaaggtcaatataaaaaagtcaattatatttgctagcaatacttgggaaaagaattttaaaatcatttgcaatagccttaaataaatcaaatatttacaaataattacaactaaaatgcaagacctctatgctgaaaatgacgaagactgttgagagaaattaaagattatctaaataaatggatttaccatatctgtggatcggaaggctcagtatgttgaattcacaattcttgtaaaattgagcttcaaattaaatccgtagcaatcagaatccccataggcattttttttttatttgcagaaattgacatgctgattctaaaatcatttggaggacttctgcttctgtagtggtttctttttttctgagacgtagtcttactctgttacccaggctggagcgcaaaggcacgatcttagcttacgtctgtctcctgggctcaagcatttgtcctgcctcagccttctgagtagctgggactacaggcgtgaaccaccacgcctagctgatttttttgtgtttgggtagagacagagttttaccatattgctcagggtggtctcgaactcccaggctcaagtgatccgcccgcctcagcctcccaaagtgctggagttacaggcatgagccaccacgcccggctgcttctgtagtggttctgattggaactacccttctgcagaaaaaaattatcaactgtgggcaaggtgcgaaaacaaaaaatccaactacctggtgatactggggaatgatcaaaggcagaaagattctggagatgacttttttgcttggaagaagggaatacattgggtgattttatttttaggtttcttttgtgtgtgtgtgagatggagtctcactctgtcacccaggctggagtgcaatggcacaatcttggctcactgcaacctctacctcctgggttcaagcaattcctgtgcctcagcctcccgagtacctgggattacaggcatgcaccactacacccagctagttttcgtatttttagtagagatggggtttcactgtgttggccaggctagtttcgaactcctgacctcaggtgatccgcctacctcagcctcccaaagtctgagattacaggcatgagccactgcacctggccatttcttggtattttctaacatatttagaaggcattcaagggtgaacaagtgatcctatgtggttgcaaagtttctacattttatgtgaaggattactctattaattttccactattgtaggttgtgaaaaattaaagatattattattctagagcaaccacttaaaaatgcaaaggcatctggctaaaaatccagtaagaagtcaaggtggcaacctaaaatatattcagattatctaaaaagaaggcaggaaaagcagcataatggaacaacaacaaaaaagggtaaaatggtatatttaaaccaagccttatgaataattatattgaatgctaatggataaatactccaaataaaagtcaaagattgataatggaattaaaaagcgagagacaactatatgcttcctagaagagatgtactttgaatgtaaagactcagatgggttgataataaatgaatggaaaatattatcccatgaaaacagtaagtataacaaggctagatttgctaaattattataaagtaaaatgggcttcattacaaagaatatttccagagacagagaggacaactttataataataaagggaatatttatcaggaagacatagtaattataaatgtgtatgtatctaataatggctccacagtacatgaaacaaaaatggatagaactaaattgaaaaacagacaatgtcacaatcatagttgaatattttaacacccctctgtcagcaattgttagaacaacttggcaaacagcaagtaaatacatagataaatggcaacatcagccattttgactgaattgatgtttatggaatacacttggaatacatggtgttttcaaatgcttatggtaagtgcagcaagaccatatactgggacataaaacaaatctgcataaatgaagaataaatgaataaattaagaaattgattacatatagtacatagttttttccatagattacatatagtacttagctttttctgtaattgaattaaatgacataaataactactgcgtatgtagaaaaactccagatgtttgtaaaccaaacaattaaactgcatattttatccatggaccacagaacaaaacagagaagaaatttatatgtgaaggtcattcatgaagttaaatcattgatctcaatgttacaaaattttcctcctatgttttcttcaagtaaaattgttataacattgggtagtgaagaaattttagctaggacactaagcgcatgaaccataaaagaaaaagagtgataaattggactttattaacattaaaaccttctgctttttgaagacaacattaagaaaatgaaaacaccagccatagactaggagaaaatatttacacggcatgtatctcacaaaagacttttacttagcataaagacccctttcaactcaatagtagaaaccaaccaattaaatatggataaaatatttgaacagacacttgaacaaagatatatgcatggccaaaaggagcttgaaagatgtgtaataacattagtcatcagagaaatgcaaattaaaaccacaacaagataccactgtacattactgaaaagacttacataacactttgtggggtagttagaactctcatacaatgctggtggtaatgcaaaatgtcacaactgctttggaacacaggttggcattttcttataaaattaatcatcaattgcttctccaggtatttagccatgagaaatgaaagtatatgtcctcacaaagagttgtacacaaatacttgtggctgttttatgcataatagcttaaaactggaaacaacccaaatgtccatcaaaacaaatgagtgataaactgccatgtatccctctcatgaaataatactcaacaataaaaagttatgaaacactgataaatgcaacagcatggatgaatctcagacacattattgtgagttaaagaagccaggctgtatgattccatttaatggaaattctagaacagcaaaactacattgtaatgacagaaagtagatcacagattgattacaaaatgttgcaagggaatattttaggatgatgaacaatttctataatttgatttaatagtggttatataggtgtatgcatttgtcaaaacaggtcacaatactgaatatgggttttattcatctgtcatatacttcactaaagggaagaattcacatgaccagatttatttagagctatactattttaagattatcaatatagacttgggtttcaatattgattattctatgccaccagtttcagaagtacaacacaaactattcaatttacctaattattaagtggaaaaaatgtagaacaaattcccaataggaaattgcttagtgttcacattcgttatgaagtttactgcttttctgaagcaaaatcaagctagttttccccatatatttttggaaacctgcatgtaaaagaaatcccaaagttaatggggggaatatactgtttagagctcaagttgggggtacttttgaccctttgcatttaacacagattattgatattgaaaaaatatttgttgaattgaaatttttccccttttgtgattgagagtcaacagaaataacaaatagaaagatagctaggatgaatgtaaaatcttaacatttcttagcacatgagacttgtatatagaatagcataggtaattgaaataaagtgaagtattaatatatgatttctagcaacttgtgttaatcaatataaaaataggtaattagtagaatttattttaagtctgtaaatactattttaagtagaatctatatctggtatggaaggtaaactattggtcatgtggcaaaatattaacatttggggaactgggtgaaggatatacagtaagcccttgcttaaggtcatcatgagtaggtttttggaaactgacttgaatcaagacagtgtacaacaggtcctcaagtaacattgcttgctttaacaatgatgaagaaaaaaacatggttttgttatagaacattttgcttaaaatctcctgaatgcagaggtttttcttttttgaagaagccaagtgaccaacagattgatcactggtgtctttgctgcctatatgaaaatttgcatagcagagaaagttttaaaagcttaatggcagaagatccagagtctcaaaatttgccaagcatgctactagatgttgtggaaaaaataaaggcataaagcatgggacttgccttcatggaatttttaatttagcccaggtcagagaaatttatgaaactgtacttagcaatactaggccctttaaactacaaatggatagcacagataaagatatcctctagttgctaagaaaggaagacaatatttaggactgagcagtcaaagaaggctttgttcactaagggaggacttgagttggaacttgaacaacagatagggtttagatggagtgatatagcataagcaaaggcaaggagacgggagaatgtaagttgtatttgggtccttttgttgagggtaatagtgagacttagggaaaagtagatttgaaaaagtttttaaatgacctacctagcaaggataggggatttggactgctcttccacttctactgggaattatttatagattaaacttggaattttaaacttactgtcatttggtactgatttcaaaaatgaatgctcttttaagtagataattaaaaagcggggatagttctgctttttgtagtatttctttgttccttgctttggaagatcagtgtgacctgggtgggcatcgttcgatttggctttagtgtagccaaacaatcacgcacaggagagctctgagctggctttgatttatgtatggaaaaagcagctatctgaaagcgccttcagtgtttaaaggagtagcctggttgtgtgtcatttaaagggatcctagtgacctttggaagaagattatttgaaacgtgcagtgacaagaatgagaaggaaatttgtttttaatagaaatgacactctagatcctctttgatgatggtacagaattttctttgctacttttctggggcatgagggaaatgcccatacagtgggaaattgctagctgaataaaatagtaagtccttcttaggtacatatatagcttgtcatcatatgaatatttacttttttttttttttttgagacagtctttctctgcccaggctggagtgcaatggcgcaatctcggctcactgcaacctccacctcccaggttcaagtgattctcctgcctcagtcttccaagtagctgggattacaggcacacgccactgcacccagctaatttttgtatttttagtagagacggggtttcatcatgttgcccaggctggtcttgaactcctgacctcaggtgatcagtccacctcagcctcccaaagtggggggattacaggcatgagccaccgcgcctggcctgcatctcttaatctttgatgaatacttctcttttgttctcaaaatatcctcttatacaccttatcaacaattgctgaagagaattgattctttaatttataaaatattataactataaataaatattactagagtttatttcacattcacaacagtcataaaaatattaaaagtacatgaaagattacatacttgtaaaagtttactggctcaatgagtcaccttttatagattttggtcaatgagaggtaagaaatgagagaacttttcttaagacaggcacacaaatgttatttgtaagtggtttctggcctttgttttgatgtgtaaaagtggaaattccatctcatggataagtacatggttgcaaatggcatgaggtttttcagcagtgtgctaattctgaatgtggggatattcttttttaattttttaggttttttttttttttttttttttttttgtagagacaggtctccccatattgctcaggctggtcttgaactcctgggctcaagtgttctgcccatctcggcctcccaaagtgctgggattataggcgtgagccaccacacccagccatgaaagcggggatttttgaatccaccaactttctgagggctctttttcaaacccattttgatttttaaccaaatacttataacttagtgagctgatatttcatcaaattaccacagttaatagaatccatggttaaaaataagacagcatttacaactatgtaattccacatgaagtacctggagtagccaaaattcatagaaccaaaaagcagaacgggttgccgggggctgggggaagggggattgggagttgtttaatgggtatagagtttcagctgcaagatgaaagtagttctggagactggttgtacaacaatgtgaatgtacttaacattactgaactgtgtgtttaaaaattgttaaaatggtatattttatgttatatgtattttaccatagtttttaaaaattaaaaagagaaaagcatttgtaatagtgtcaagaaacatcaaattcctaggaataaacctatcaaaagatttatgagatctctatactaaaaatctggtggggcacggtggtttacacctgtaatcccagcactttgggaggccaaggtgagcagatcacttgaggtcaggaattcaagaccagcctggccaacatggtaaaatcttgtctctgcaaaaaatacaaaaaaaagttagccaggcgtcgtggtgaacgcctgtaatcccagctacttgggaggctgaggcaggagaatcgtgtgaacccaggaagcggaggttgcaatgggctgagatcgcactactgtactccagcctgggtaacagagtgagactctgtctcaaaaaaaaaaaaaaatctataaaacataattaagataaattaatgaagatgtaaataaacggagtgatacgtcttgttcgtgacttcatgttttaaaatttcaagtctttccaaattaacctacataattaatacaatccttaagaaagtcccagaactttaaatttgttgtttttattgtttctgttgttttttcgtgaagctaaaactgactttgaaattcatatggaaatgcagaggactaaggatatagctcaggcagtcttgaagaacagagctggaggggaggacttctgttgtcagatagcaagacctattttaagacagtgctcatcaaattggggtccctggaccagcagcatcagcgtcacctgggagcttgttagaaatggaatttctccggctccaccctaaaccctgttcagtcagaacctttgaggttggagccaagaactctgtgttttaacaagctcttgaagttatttttatgctctttaaaaacacagaattaagacattttgacacaaggaaatataaatcaaccagtagtctagaaacagatccatacatatacagttcatgtgatttatggcaaaggtggagttgtaaaacagtgagaaaggatagacttttcaataaatattactaggtaatttatatacctctaggaaaaatgggcatcttacccctacatcatactgtatataaaacataattccagatagatcaaatatataaaagtgaaaagcaaaactataaagctcttagaggatgaatgtaggagaacatctttgagaccttaggacagtcacacaggacagtaaagcgctaacaaaacaaaaaatggtacgctggaccatagttagcacttctttttatgaaaagataccattactgttgtaaagcacttagactagtgcctgaacagcacatagaatgtgttatataaatgtttattaaataaaactaataaataaaatgaacaacaaaacagcaaaaacagcaaacttgtatcgagaacaaataaaattctggttagaaccaccgttgtagaggcttttgcagttgagtagttactgcatttttctcagaacaagaggctaactctctagtcgtcagccttttggtaatctctgttatttaggaccagttttagagtgaactgttcagaaattttcttagcatttctaagaaatgagtatgaattattggaataaaaatatgaattataagaattaacaacatgtagtattttatatcttcataaaaatgtgtcctttgggagaaataaataattgaaattaaagtgtttactataattaactatacagaaacatatcagagccttttcatgtgctaaaataacccagcttttgggaaaaaaattctgaaatttgggagcgtggtatatatgcatactggatgcttcatgcaaaatattattagtagccaggcctagtggctcatgcctgtaatcccggcactttgggaggccaagacaggaggatcacttgaggccagcagtttgagaccaacctgggtaacattgtaagatccatctctattaaaaaaaataagaaattattagtgactttaaaaaagtaatgaaatattactttgggcataattatatttctgtctttatatgttctgtttatgtttttagcaacacaaaatttgaatgtaagattcctatttctttttttttttttttttccacaaggttttgctctgttgcccaagctgaagtgcactggtatgaacacagctcactgcagcctggacctcccaggctcaagcgatcttcctgcctcagcctgtcacgtagctggtaccagaggtgtgcactgccacaccaggtttttttttttatttttattttttctagagacagggtcttgctgtgttgcttaggctgatctcaaactcctgggctcaagcaatcctcctgtcttggcctcccaaagtgctgggattacaggtgtgagccactacggccagcctgctctgtctttttaaggattttgacagtagtggttttgtaaaatacatatttttttatatacataacacaaaatgtaccatcttaaccatttttaagggtacagttcagtggcattaagtacattcacagtgttgtgcaaccatcagtattatcaatatgcagaactttttcagctttccaaactctgtatccattaaacaataactccctttctcccctccctttagcccttgcaactaccattctactttctagccctatgagtttgactactctaggtaccttgtttaaggggaatcataaaatattttttcttttgtaggccaggtgtggtgacttatgcctgtaatctcaacactttgggaggccaaggcgggtggatcacctgaggtcaggagttcaaaaccagcctggccaacatggtgaaatgccatctctactaaaaatataaaaaattaggccaggcacggtggctcacgcctgtaatctcagtgctttgggagaccgaggcgggcagatcacgaggtcaggagttcaagaccagcctggccaatatggtgaaaccccatctctactaaaaatacaaaaagtagccatgcgtggtggtgcgtgcctgcagtcccagctactcgggaggctgagacagaagaatcacttaaaccctggaggcggaggttgcagtgagctgagatcgcgccaccacactccagcctgggtgacagagcaaggctctatctcaaaaaaaaaaaaaaaaaaaaaaaaaaaaaaagctgggtgtggtggcgggtgcctgtagtcccagctactctgtaggctgaggcaggaccatcgcttgaacccttgaacccaggaggtggaggttgcagtgaaccgagatggcgccgtcgcactctagcctgggcaacaagagtaaaactccatctcaaaaaataaaataaaataaaataaaatattatgaaagtaaaaataaataaacaaataaaaatacgaaaattagccggtcgtggtggcatgtacctgtaatcccagctacttgggagactgaggcaggagcattgcttgaacctgggaggtggaggttgcagtgagccaagattgcaccactggcactccagcctgggtgacagagcgagactctacctcaaaaaaaaaaaaaaaataattgttcttttgtgactgacttcactcagcatggtgtcctcaaagttcatctgtgttgtgtatatcagaatgctattcctttttaaagcggattgatactctgttgtttctataccacatttttgtttattttattttattttattttatttattttttattttttgagacagagtctcactctgtcgcccagactggagtgcagtggtgcaatctcggctcactgcaacctccacctcctgggttcaagcacttctcctacctcagcctcccgggtagctgggattccaggtgcccaccatcacgcccagctaatttttttgtgtgtttttagtagagactgggttttaccatgttgcccaggctggtttcaaactactgaccttaagtgttccacctgcctcggcctccgaaagtactaggattacaggcatgagccaccacgcccagcctataccacattttatgatccattccttcacaaacatttgagttgtttttgccttttggctatgtgtataatgctgccatgaatattggtatgcaaatatctgacttcaattctttcaggcatgacccagaaatggaattgctaaatcatgtggaatactatatttaatttggagataattttttctaatgcctagatttacttttttcatacaaagataggataaagtatcttctacagaatatagagcagtcactaaaagttttacagttcctgttattccttgatgtattttgttttccactcagagaattagtgagtagccgatgggcgtggtggctcacacctgtaatcctagcactttgggaggccaaggtgggctcattgcttgagcccaggagttcgagacccgcctgggtgaaaccctgtctctacagaaaattaaaataattagccaggtgtggtggcaagtgcctgtagccccagttacccaggaggctgaggcaggagaatcacttgagcctgggaggtgagggttgcagtaagccgagactgcaccactgcactctagcttgggcaatagagtgagaccctgtctcaaaaaaaaaaaacaaacaaaaagaaatagtgggtagctagaattctatggtaatagcaaattatatcagcttatatttaggtccatgtattcagttactcattgcctcttattatcaaggctgaaactctgtgcttatttaacctctcaatatgtaagacaccattccaaatctgatgagtcacaatttggggttttcaacatcttcttttatctttaccaatttttggcatctgagcagtttagctgttcttaagtacttctttcttacacttttactgaacagtaaagaaatgtgtttataagatatttcagtaaatgtgaagtttgtaataattgcatttagcttaatgttaaaatagaaaataaccaaaattcaacaaagatgaacttattttcccttcattactgcagaattttggaggtggttggtcaacttttagtctacatttttctctttatggataagacatctttagtcacacagagcttaacctgcttattcaggggcacatagataatggctgggacggtagaggaattcaagctagtttaggaaagaaagaatttttttttttttggagacagtttcactctgtcactcaggctggagtgcagtggaatgatgttggcacactgcaacctctccctcctgggttcaaacgattctcatacctcagcctcctgagtggctggaattgtaggtgtgcactagcacgcccagttaatttttgttatttttaatagagatggggtttcactgtgttggccaggctggtcttgaattcctgacctcaagtgatctgcctgcctcagccccaaaagtggccactgtgcctggccagtaataattaatcttaatttgtagatttttacaaagcatggtagcacattatgttggtaccttattatattattacttgccatgaagcaaatggaatattatgattattatttttgatacagggtctcactctgttcagcccagactggagtgcagtagtgtgatcatggctcactgcagccttgaccagactcaagtgatccttccacttcagcctcctgagtagttggaactacctgcacatgccaccacacccagcaaatttgataaatttttttgtagagacaggggcttgctatgctgcccagactgatttcaaactcctggtctcaagtgattctcccacttcagcctcccgaagtgctgggattacagttaagccatctcacccagccataaagttattattattattattattattttttagcatttggaacatgttgtctttttttttttttttgagatggagtctcgctctgtcacgcagcctggagtgcagtggcgcgatctcagctcactgcaagctccgcctcccgggttcacgccattctcctgcctcagcctcctgagtagctgggactacaggcgccccccaccacgcctggctaatttttttgtatttttagtagagatggggtttcaccatgttagccaggatggtctcgatctcctgacctcatgatccgcccgcctcggcctcccaaagtgctgggattacaggcgtgagccactgcgcccggccaaggaacgtgttgtcttaaagaaaaaatattttaagtagtgtttaagtttctgagctgcattacaaaagcctatataaaccccagattgcctaggtcacagtaataaaagtattatgtcaggataactagttattatttacaatattatgtccttgggagcatatgttcccaattctatctagagaatgccccaaaaaagaatctattaggtggattttcatgagcaccagtcactgttagttttcatttctgtttccgaagaaccacctttgtatgcccttgtccctttgtaaaagaagacagaagaaaagtctctttctttgtccctctttttatccctttcttgcagtgcacccaacagtatgtaaggcactaggaatcaaatagctgggacttctgccctggaggaaccaaactagatgcagttataaagaatcactggatagagatggagtcacttagatgaggtggttgagaaggctccctcacaaagtggcattaaggccaagacctaaatgagacagagccagccttgtaggcattggggtgatcacttctcaagttctaaatggaatggaattaagagcagtaaccccctactggggggcgtggtgaagactctgaattaactctatccaggtgtttatgtagattatggcttgagctctcaccagctggggttggcctgctgcttaggtaggttagattggtgttctctccattgcatttggttgctgaaatttttttaaaatgccattttctaataagtcaatagagcttcataaaccaacatatttcctgtttagttttcttcttacttatccaatgtcccatattatggtcaattcttacctcatcatgggcagcagtgttttataaaatatattgaatatagcctatgtgcaattgctccctttcagaaagactttctcaagtctttatatctcccagccaaatagacatcatcacattcttcagtgatgctattatccagttagttccttctttaaagcttttcaaatgtctgtcagattgtatcttattttcagtatttagtgagaatgttttggttgaccttcaaataaaaatcttaggcaagcctcttgttctcataccagtgtagaaaacagtgtgtctttgttatctaaggaagatatttcatccctttgctgtgcaagcgtttgggacaacctttttaaaggtgagttttaactctgacaagcccatgggctgagctggtctgtgcactgcaccattgttgctagcagaatgatcagtgtggttggaaggtgagcaccgttgcccatgcccactccggagagggattttctgttaagggtgagtgtaaacgctggaggaggagagctcctggaggggccagatgtgcttttcagtgggaactctcataggctccattaagctttacttattcttacttacttaatgctcccaactctgtgagagatgggaatgctcctccaattttagagaggaggaaagtgagacacccagggaggtcaagtaacttccccaggtcacttggtggggctgggatgcctctcaatctttcactctgcagacttttcccactgttttacagagccttttcctcagtactcttccattttgttgtcatgggattatagatgataatccctttaataagatgaaaagaaaatgaaggcagtgatgtgacccgttatgggtagtggaatcagttttgcagatttacctaatgagaaaagtcttttcctttgaaaaaaaaattttttttttgacatagttttgcgcttgttgcctagatcgaagtgcagtggtgcaatctcggctcactgcaacctccacctcccaggttcaagcgattcttctgcctcagcctcctgagtagctggtatcacaggcactcgccatcatgcccggctaatttttttgtatttttattaaagactgggtttcatcacgttggccaggttggtctcgaactcctgaccttaggtgatccacccgcgtcagcctcccaaagtgctgggattacaggcgtgagccatcacgccctgcctgaaaagtcttgagatcacattttataataaaatctgacaagtagtgttgtacattttaaagaattagtttttttaatgtcttctctttcatatttttataggtccatatgcacctattatgttggtaaattcattctttttgtagatttaagttaatggaggccaacgagataaggttatgcattaaatcttgtaaactatttcaaggggatgaaaatattttaatttgcaaagttaattatagaagaataagattagaatatatattttatgggggcagggatcctgtctgttttgtttgctattctgtccttagggcccagtatacactgccatgtagggagtaggtgctcaagtgagttaatgaacaaatttcactaaggttctgttcttttgattcttctctcttattcatgtattcttgatgtactcctcttccttcaccatctccaagtcctctttttacattactctactttctaatgtttctttggtagtatcatccatgtccaggaagtagtcatatcttaatttagctatttaaatgagcacaagtttatttagagaaaatgttataaaataatataaaggtgttctgggacttaggatactaagtgttagtaccagcttttgctattaatagaggtgtgagattgagcaggtaatttaacctgttggtgcttcattttcctcttattgtaagggggttggtctatattagagttagttggtctagattagaggttaaaaattcaagtgcctataggagtcaggcaggtaataaaaatgagtgaaatgaactgtaaggagtcataggctgaaggacttcttgctaacctttaatgagagtttggagttatgaatgagtttgataaaagacaaatacttactttatcttagcctaatagttcttaaagttggctacgcttgagaattacctggggggtattttaaaaaacactgatgccagcctgggcaacatagcgagatcctgtctctacaaaaaataaaataaaataaattagccgggcatggtggtacaggcctgccgtccaagctactcgggtagctgaggtgggaggattgcatgagctcaggaagccgaagctgtagcttgccatgatcatgccactgcactccagcctcagtgacagagtgagatcctgtctcaaaaaaaaaaaaaaacaaaaacaaaaaaaaccagctaccaaaactgacacccacatcctgctctcagagatctgatatacttttagaataccaagcttcccaggtacttctaatgagtagctagattttcagtgattaattgtactctaagatgttttccaaacctgactttttgaaacaagagaaggaccaagggtggcatcaactttcagataaataaacaggtctttctcctttatttgtggtaatctttactgaaagtaattgttgtaaatgatcaccgagacaatatcagattccaagttgtcatcaaagagagtttacattgtgctcattatactaaggagtcagtgtttatcatagtacattttgtccctgttttcacttatccagtactttcattttgcttcccactacacttgtgatcatattggatgatttctactatgttctctgggtaatggtggtcacagctttctctggggttaggtttcagtgtgtgcatattcagttttgatataggccagtctttgttaagatgccccttctaggaatgcattttcattaaaattggaaactccctaccctaacaaatgccagaaagcattctcatatgttttagaatgatttctgtaatacaaattgagaaaaagagaactttttgttaactgggaagattttcaaatctgtgtttaactgtaccctgatattttggaagaattaattttgtcctattcagaatgagatcacctagcttatctcttttctatgatttttttcttcccgcttctatcagtgtttgctttcacaaccaaagttctgggccattcagacatcagccttgatcctccggacaaaacttgagaaaggaagtactcgccgagtggaacgggcaatgaggcagacacaggtaagaattaatgtggcaatttgtgtgcttcttccaactctctattgctatcagtaagcatacatgtttgctatgaatgaaggaatgaaatggcttacatttcactcaaataatttgttactgtttagagaataagttctataatttaacttcttggttccaaagcccagctctgtgacttagcagctctgtgaactcggtatttaacctctccaaacctcattttcatcatctgtaaaagaggttaataataataacagcacttaggctgggcgcggtggctcacgcctgtgatcccaccactttgggaggccaaggcaggtggatcatgaggtgaggagtttgagaccagcctggccaacatggtgaaaccccgtctctactgaaaatacaaaaattagccaggcgtggtggtgggtgcctgtaatcccagccactcgggaggctgaggcaggagaatcgcttgaaccctggaggcaaaggtcgcagtgagccgagatcgtgccattgcactccagtctgggcgacaagagcaagactccatctcaaataataataataataatggcacttacaggtttatggtgagcattaaaagagacaatagaagaattaataaataaagatatgcagccccataggtatgggttgtataaagaagtaaaattcatcctgatgcaaaaaatattcactaatgaactaaccacatgtaagattaatccatattcaggtaccgttcttcatttaatgctaatgtttattcctatccagtgagtcaatagcatttagtctcttttacacattttctcttaaactatccatgatgcaaatttattaccaagaaaaatggaaaatcttacaatagatgtaggatttcgtaacgtcaatgtcttagtctgtttgtgctgctacaacaatatacctgagactaggtaatttataaagtactgaaattcatgttctcatagttgtaaaggctggaaagtctaagatcaaggtgctggcagattcggtgtctggtaaagcctcattgttcatggatggcactgtctaggtgttctcatacgacagaagagtggaagagagtgaacccatccttttacaccattttataagggccaaagtcctgcttatgagggctctgccctcaggacttaataatttcctaaacatcctactgcctaatactttcatattggccattaagtttcaacatatatattttggaggacacattcggactatagtaattaatgaaagtgatttttttttttacttttttttgacacagggtcttactctgttgcccaggttggagtgcagtggcacaatctgggctcgctgcaacctctacctctggggttcaagcaattcttatgcctcagccttctgagtagctgggattacaggcatacaccaccatgcccggctaatttttgtatttttagtagagatggaggtttcaccatgttggttaggctgctcttgaactcctggcctccagtgatctgcccgcctctgcctcccaaagtgctaggattacaggcatgagctgctgtgcccggccaaaaatttatttttattttataaaaatttcaaacctatgtaaaagtcataagaacagtacgaagaattcccatatagccttcaccgtgagatctcgtttaggctttatcaacttgtcctcataacatcctttgtagcacagggatccaagcctggcatttcactgtcatgtcctctcaggctcctttattccagaacaattcctagtccttttttgaccttgatgggtttgatgcttttgaagattatgggctagttattttggagactgcccttcagtttgagtttgtctgatgtttcctcatgatttgattcaggtcatagaattttggctgtcatattgtagaaatgatgtagtactcttcttccctcaggtggcacatgatgttcacttatcctgtcactggggatgttatttgatcattcagtaagcttgtgtttgtgagatttctccccaagtaaagttactctactcttttcccattgtaattaataaacattttcaggaagtgatatggtttgagtatttgttccctccgtatctcttgttgaaatgtgattcccattgttggagatggggcctggtggggggtgttggggtcacgggagggagcagacccctcatgaatatcctagtgccctccccacagtaataagtgacttgtccctctgttagttcatgtgagagcttgtctgagagagcctggcttctcttttgtttcctttcttgccatgtgatccacttgcttcccttcccttctgccatgactataagcttcctgaggcttcatcagtagctgaggtacatgcttgtacagcctgcagaaccatgagccaaataaacatcttttctttataaattaccaagcctcaggtattcctttacagcaacacaaaacagattaacacagggagttactttgagaccatctggtttgtcatctaactttcacccataggttttagcatttattcttttctttttacatttttatttatttattttttacttgccactatactaacgaggaggttttagcattttaaaaaaatgtatgtatttattcatttatttcttcttagagacagggtcttgctctgttgccttggttggagtgcagtggtgtgatcattgctctctgcagcctttgcctcctgtgctccagtattcctcctgtctcagccctcagccttaccactagttagggctacaggtgcatgcaactgtgcctggatagttttttaatttgtcatacgaggtctcactatgttgtccaggctggtctagaactcctgacctccagcaatcctcctgccttggcctcccaaagtgcttggattataggcgggagccacctactatttattgatgtatcttctctgcataagttagcattatgtattgccaagtggtaattttctaattccatgattatttaataattttttaaattggtattctactgtaaggaagagctttctcttctcatttatttttccatgtatttatttacttgattatggacttatggattcctgttttattttatggggtgtaatcttacattatcattccttatttaccttactctttttttttttttttttttttttttgagacagtcttgctttgtcacccagactggagtgctatgacatgatctcggctcactgcaacctctgctccctgggttcaaacgattctcctgcctcagcctcctgagtagctgggattacaggcatgtgccaccatgccttgctaatttttgtatttttagtagagacggggtttcaccgtgttggccaggctggtctcgaactcctgacctcaagttatctgcccacctcagcctcccaaaatgttgagattacaggcatgagtcactgcgcctggcctatcttattcttaatttattattgtgacaaaattttagcccatttgaataagtattaatcatattatttgttgctgtattaaaaataaatccacagacagaatgttatgataaaaacagaagtgggttttctctgtcagagaatgctaattttagaacctcaatatccattctccctgctccctcgcctttttgtttttgagacagagtgttactcttgtcgcccaggctggagtgcagtggtgcaatcttggctcactgcaacctctgcctcccaggttcaagcgattctcatgcctcagcctcctgagtagctggaattacaggcacgcaccaccatgcccagctaattttgtatttttagtagagacagggtttcaccatgttggccaggctggtcttgaactcctgacctcaggtgatccacctgcctcgacctctcaaagtgttggattacaggcgtgagccactgcgcctggcccccttctttattttagtaatagaacctcctgaattttatccaggcacatgacttcctgtcctcttttgcaggttggagaggccaggtgactaagttgtgaacagtaggatgtggatgaagtgatatgtaccacttctgggtcatacccttaaaagggaatgtgtgctgtcctggcactttgtcccttcccattggctgggaaatcaggagaactgggctgccagcttagaccagaaatgttttgaaggtggctgagcccttttagcagttctgagccattcattgttttagtctattttctgctgtgataacagggtaccacagactgggtaatttataaagaaaagaaatttgtttcttacagttctggggacttgggaagcccaagagcatggtgtcaggatgtgatgagggtcatcccctggcagaagggtagaaggcaaaaggaagtatatgtaagagagagagctcccttttataacaaagccacttccatggtaattaacccactcccatggtaacagcattaatccattcatgagggtagagcccccacctcccaccactgttgcatcgggcaccaagttgccaacacatgagcttttagaggacacattcaaactatagcactgttgaatttgtaaatgaacgagaaacagaattctgtcttgctcaagtctactttttgatctttttgttatagcagtttagtctatatcctaattaatattcccttattccaaagtttaaaaaaaaactaatgaagtatattttattaatttctagaactaaaaatatttctgatggccacctcactaagtttaggtcgctctattgatgtttcttagaaatacaaatattattccttaggttttatatattccatagctctgtccactgagagggcctagaagcatttacagctcagtagcaacaagcacatctagtgccagattttattttttaagtatcattcttcaacaaagggtagcagagctccttggatagatggctggttttaggattggggcagctggggcagggaaaatgatgagcctggaacatcttgtagtgccaggaagtaaggtagtacttaacaacaaaaaaaaaaagaaatgaggtatgtcaaaaggacacagtagctaatctaaagagaacccagtggtcaaagctagaacaatttgagcagcaaattaaatagtacagttgacccttgaacaacactgctttgaactatacaggttcgcttatatatgggttttcttttgcctctgccatccatgagacagcaagaccaattcctccttttgcttctcctcctcagcctactcgatgttaagacattaaggaggaagacctttatggtgatctacttccagttaatgaatagtaaatatattttctcttttttttcttaatagcgttttcttttctctaccttgttttttttttttttttttttttaatgagatggagtctcattctgttgcccaggctggagtacagtggcacaatcttggctcactacattctccgcctcctgggttcaagcgattctcttgcctcaaccttctgagtagctgggactacaggcgtgtgccaccacaaccagctaatttttgtatttttagtagagacacatttaccatattggtcaggctggtcttgaactcctgacctcatgatccacctgcctcagcctcccaaagtgctgggattacaggtgtgagccactgcgcccggcctctttttttatttttctagcttactttattgtaagaatgcagtatattaagcttgtccaacccaccttactttgttgttgttgttgttgttgtgttttgttgttttaggcttttagcagcctgaaaccatgtttttttagtttctgtctctaatgataagtggaaaagggggatgaggaaggggctttctcctggcttaaccagaaatagaaactaagaacccatgactctatctgctcccttggatacccctgttgggtatataatacatataacatacaaaatatgtgttaattggctatttatgttatcagtaatgcttccagtcaagagtagactattagttaagtttttagggagtcaaaagtcatatgctgatttgtgactgcataggggggttggcatcccaaaccccacattgttcaagagtcaactgtatttgattgtaactcaaagtataagataaatatacatgagtccatattgttataaatgaatgataaacattgatgaatgataaattttggataaatggaggagaggggacaaatcttccttacagtagaattctaaataatttatgtaaatatatgcccctccaagaggtagagattaataccccttaactgtgagctggacttaatgactcacttccaaaatacagagtatggaaagggaaagatgtcagttttacagtggaaaaaactagcaaacactaccataaccttgtgattatggttaatatcactggtgataaaactgttgatacaggttcagtctcccttatctgaaatgcttgggaccagaaatgttttggattttggattgttttcagactttgaaatatttgcatatacgtaatgagatattttggggatgggacccaaatctaaacacaaaattcatgttactagggtacaacacctgttgaaaagaaatagaaagaagcagaagaaaatgtcaatccgaggtgttggctcagtagagcctacagtattccccacttggctgtctccttgggctgaaatggctggacctgtcctctgccttctcttccctatcactggatatgggcggcctcaggggcatgacctcaggctaggtgctctgtagctgaggtgatgctgaaaaagctgatagtccgaggcagtctgttgtccccactcccacagctgggccccaccgtgtagagcaaagagggaaggtgaagatgtagttgattagcatcttcaattatggtggattataccattgttttaaagtttattaaaaattcagtttacactaaaactgtaaaatgttgaaatggctaaaatatagtttatttaaggaaatacacataatactttttttacattatggaaaaagtttaagtgtctgttgttgttaaagcttcagccttctttttttgtttgtttgtatttgagataggaggtctcgctctctcacccactctggagtgcggtggcatgatctcggctcactgaaacctctgtgtcttgagttcaagtgattctcccatctcagcctcccgagtagctgggactataggcatgcaccaccgacttaattttttgtatttttagtagggttggggtttcgccatgttggtcaggctagttttggccttcttaatagaaatagtgctagactacatcacttattgatgaaggacatactgacctagaaataatttgccttttagccatctctttcagtaactttggcaaataaaataactaggtcagcattcatttttcttttatagcagcaaattaaactaaaaaagtgaatcttttaggtgtttataagtatatagctttttttttttttttttctgagatggagtcttgctctgttacccaggctagagtgcagtggcgtgatctcagcttgctgcaacctctgccctcccaggttcaaccaattctcctacctcagcctcctgagtagcttggattacaggcatatgccaccacacctggctaattttggtatttttagtagagacgggtgtcaccatgttggccaggctggtgttgaactcctgacctcaagtgatctgcctgcctcagcctcccaaagtgctgggattacagacgtgagccaccacgcccagcctgtatataccttttcagttctaaacctgcatttgtgaagattatgtttttagatatcaaataacaagaatgtgttttgagtgggaaacatagatttaaaagaaggctgggagcagttgctcacatctgtaatcctagcactttgggaggccaaggcatttggatcacttgaggttgggagttcgaaaccagcctggccaacatggtgagacccccatctctactaaaaatacaaaacaattagctaggcatggtggtgggtgcctgtaatctctgctactcgagaggctgaggcagaagaatggcttgaacccaggaggcagaggttgcagtgagctgagattgtgccactgcactccagcctgggtgacagaccaagactctgtctcaaaaaaaaaaaaaaaaaaaaaaagaagaagaagaagaagagaagagccaaatcactgtgctctggcattttacctttgcattggccttactatatttggggttcgttcattttgccattcaaatgctgcattatcaagagagttgcgtagtccactacctgtagaacagaattagacagttacttctgcctccgcagggtagtactgtagaaaattctctttacttccccaacgcagaaatcttggaaattagtcagatcatgtgacaggatgaatgcacaatttgtctaagtttctgtcaatgttgaggcatttagctcataatctgaacttctgccaattcccctgattcagaacttgatattactttgtttgttgaagttactgcatccctgaggaataagaggaaaatgattttaaaattacatgtatatattaagacagtgttgtgtttttttaattgttttagtttctatgaaaatctgttcccttccacagcagtgtaaagtgataaaatggtaaacttaaaacttgaggaaaaggctgggggcggtggctcatgcctgtaatcccagcactttgggaggctgaggtgtgtggatcacctgaggtcaggagttcaagactagcctggccaaaatggtgaaaccttgtctctactaaaaatacaaaaattaactgggcgtggtggcaggcacctgtaatcccagctactcaggaagctgaggcaggagaattgcttgaacccatgatgtggagtttgcagtgagccgagattgtgccactgcactccagcctggtgacagagtgagactctgtctcaaaaagaaaaaaaaaagacttaaggaaaataagctagaaaggacccccttaggaaaaagtttaatcttgttctattatgtgttgaggaaatgcaggtgtgatgaagtcaggtaaccttgccccagtttgtctggctagttagtgacagtctggactacacagacttacatggttgccggcagttacactgaaggcttcaacggcaagtcctaaggaatggcagatttggaagagatctctaagtgagacgtgccaaacttgaaaagaaaatgtttaatcacaactaaaggtaaataaatcatgattataagatccacagaagaagaagaaactccaagtcgaggacaatctattaaaaacaccctgtcttctgaaattatttcaggctgcaattttttattgcatgttcaaggcagtggtgatgttagtgacaatgaagaaaataatgtttatggaaactattttaatggctatgattcagaagctgcttgaaataaaataagattatattcttcagtaatcatttacaccctgcttttctaccagtggagtataaaatagtgttctctatcgtcattctgcctttccttccgcatctgatctaaattctttttttttcttttttttctttttttaaatgaggcagagtctcactttgtcacccaggctggagtgcaatggcatgatctcgggactgcgatctccacctcctgggctcacctgtttctcctgccttagcctcccaactacaggtgtgcgtcaccacgtctgtcaatttttgtattttttatagagacaaggtttcaccacattacccgggctggtcttgaactcctgggcttaagctattcaccttccttcgcctcccacagtgttgggattacaggcatgagacactgcacccagccttaaattcttatattcaacattttatcagaagatcacatccttttcttttatatgctgtggtttatgtgcatctcccaaagttgatgtggtggaaacttaatccccaatgcaaaagtattgagagatggcacctttaagaggtgattaggtcattaatggattaatgccagtatttcaggggttaggttcctgataaaagaatgagtttggcttccttccctctctctctcttgctctcactctccctcttgtgcctctgccatgggatgatgcagcaagaggtcttttccagatgctggcccttccatcttagacttccccgtctccagaactataagaaataaaatctctgctcgttataggtgacccaatcctaatattctattacagcaacacaaaggggctaaaacattttataatccaaatgtgaagcaaattaatggaaactacatatattcaaagggaccaccttatttatgtccaaaacaaaacatttttgaaaaaaaaattgtgcaaaccaaatttgtcattgtcttctttcatatcaaactcctttcacatggtgttagataaacttagttcagtctttggagatcaatgttagattgttttatgtttattactgaaataatcttgataatgaattttaattacttggttacctcttacacctgttaatttaagtcgtgaagttctgtccctgtccaagccgttgtgcctctgaagatatttgtccaacaggaatatttttcttcttccttggatttccaggaggacattgcattgaattggaaatttgagattattgcagttttctgtccctgaagtctgtttatactgcaatttgactttcttaactgtgttaattaagtcagatttcacaatttttaaatgacttttttcctagaatatttgttcttttttttgacttttaacttaggctcaggggtacatgtgcaagttgttaagtaggtaaattgtgtgtctcagggttttggtgtacagattatttcgtcactcaggtaataagcatagtacctgataagtaatttttcaattcttagctccttccgctctccaccctcaagtaggcctcaatgtctgttgttcccttctttgtatccatgtgtatccaacatttagctcccaattataagtgagagtatgcactatttggttttctgtccttgcattagtttgcttaagttaatggcctctggctccatctttgttgctgcaaagaacataatcttgttcttttttagggttgcgtagtattccatggtgtatatgcagcgcacccccgcccccccgcctttttttttttttgagatggagtctcgctctgtcgcccaggctggagtgcagtggtaccatctcggctcactgaaagctccacctcccgggttcacaccattctcctgcctcagtctcccgagtatctggcactacaggagcctgccaccatgcctggctaattttttgtatttttagtagaggcagggtttcaccatgttagccaggatggtctcgatctcctgaccttgtgatctgcttacctcggcctcccaaagtgctgggattacaggcgtgagccactgcacctggccaggcctaccccattttctttatttagtctactgttgatgggaatttaggttgagtccatgcctttgctattgtgaatagtgctgtaatgaacatacacacacatgtgtctttatggtagactgatttataatcctttgggtatataaacagtaatgagattgctgagtctgatggtagttctgttttaagttctttgagaaattgccaagctgctttccacaatggctgaactaatttacattcccatcaacggtatgtaagtgttcccttttttccacaacctctttagcatgttattttgtgactttttaatacccattctgactattgtgagatggtatctcattgtagttttgatttatatttctccagtgattagtgatgttaagcatttttttcatatgcttgttggctgtgcatatgtcttcttttgaaaagtgactgttcatgtcctttgcccactttttaatggggttgttttttgttttttgtttaagttccttatagattatggatatcagacctttgttggatgcatttgcaaatattttctctcattttgtaggttgtctctttactctgttgattgttttgttgtgcaaaagctcttttgtttaatttggttccatttgtcaatttttgtttttgttgaaattgcttttggcatcttcatcatggaatctttgccagtccctacattcagaatagtactttctaggttatcttccagggattttatagtttttggttttacatttaagtctttaatccatcttgagttgatttttgcatatggggtaagaaaggggtccagtttcagtcttctgcatgtggttagccagttatcccagcaccatttgttgaataaggagtcctttccccattgtttgtttttgtcaactttctcaaagatcacatgttgtaggtgtgtggctctgttcctgggctctctattctgttccattggtctgtgtgtctgttttttgtaccagtaccatgctatttttgtttctgtggccttgtggtacagtttgaagtatgataatgtgattcctccagcattagaacatctgttctcgatactgtgtagttgcatgcatgctttgaaggagtggggatttttatcatagttaattatggagggaggaagacccaaaataccatgtttgttaccgttgtggagattattgctcctgtgtgggccgaaacatttctctttaaagttggtagtcctttctttatatggcactcatgacctatctcattaattctagtaatgattaagggcatgtcataatgaaacccttgattggaggaatattagtcacagtaatgtactgtcaggatttgttacactgaggctcgtacttgtgtttgaataatttgagaaagaggtcctttatgtttgttttttttttttaatactgatggaattaccacactctgcaggaattagatgtaacacctggaccaggtccacggtcagtagtagtgaagtgtgtcactgttcttaattgttttaattatatgaatgatactgctcattataaaaatataagcaatatagaagtggaaagtaaaaaacaacagctttcttttcctcttgcttgcctttcagtctcaacagtttttaccttctaaacctctttctatgcgtaagcataaatatactttgacataagtgggatcatccagtcttcattgctttaaacctttttccctctaaacataacagcttgatcagctctgcatgccagtacttgtgaatctagctcattcattccagcagccatatgtcactcttttaaatagaagtgctacaacttatttaaccaatcctttattttttaaagtgtcctttaattaatattttatttttaaactgcatattacaaattttagtactgcatataataaaaaaattagttcactcaggaggattttaaatgaaagatataaattcttccccaattctgagttcatttttagctatttcttttttagttgttattctagtggtttccattataactttaaatattacatttctttaatacttctgtctcttgatttgtcaactttttagatagaatctgttgattccacactatgactaaggaagaaatcagcacacttttcatctcctcttccatttttatgttatttttcaattgttggggattgttactctatattctattgggtaatttttatcatgtatgtttgttctatatgttttttttttctttcagagacagggtcttgctctgttttccaggctggagtgcagtggtacaaacatggctcactgtgcagccttgacctcttggactcaagtgatcctcccacctcagcctcctcagtagctaggaccatagatacccatcaccatgccaggctaatttttaagttttttgtagaggcagagtcttgccatgttgcccaagctggcctcagacttctaggctcaagcagtcctccagccttaacctcccaaagttttgggattacaagtgtgagccactacacctggctcagatttttttttaatttttttttttttttgagacagtcttactctgtcacccaggctggagtgcagtggcatgatcacagctcactacaatcttgaactcttgggctcaagtgatcctcctgtttcagccccccacgcccaactaatttgtaatattttttttgagacagggtcctactacattgcccagtctgatctcaaacttctgacctcaagtgatactcccacctcagcctcccaaagtgctgggattacaggcatgagccactgtgtctggcctatatgttgatttttttaaaacttcaacccaatcttacagcattgtaatgatgatgctgtgagtgtactgattattgattatacaccaaatggtgtgattggacccatggagaaggaaatgcagtgctccgtgtctaagtgtttgccacttgaaggaagctgtcacaagaatcaaggtccaggggattctccactgatttcttttttgctctttgctgtaggtcatggtcagctaccactgcttctttcctgttagttattatctttcttgtttcctttttttttgtattgcctcattgtgtaactttttcacatgaagaacaaatgtagttaaatttgtgtctttgtgaaaagtatttttccatcataattcagtagtttgggtgtatagaattctagttgcaaaatcatttttcttcaggactttaaatgaagtcattacctcaatatcgtctgtcatccaagtttgctaataagtatggcagtctgatttttgtcttgttttaagttctttctgttcttcttgttttgaaattttttagaattttctctttatttttggaattctggatgtatctaaatttgaccatgggctctggagtcatgcagcctggtttccgatcccagcgctaccatatattatacctgcttataccttggacaagctactgaacctctctatgcctcagttgcctcacataaataatggaataagtagagtttttatgagcattgtatgaattaatatttagatcagcatctcaggctggaagggcttaataaatgttagttgccataattattatttctcttgctggattatatattgggttatttaaatataagcaattatgactctatagatgaaacaatttaattatactttaattaattatacttttttcttcattctttaaaagacttctttatccaattcagttctgaatttggaattttagtagaactatgtggagacctcccagatctatcttctgtgcctcttctaagctgtttgtctttttgattgatgttataggagatttcttccatcttttctcctgtattactaattttgaccattttgaccaattaataatatttagtccattcataaaattttttattttgacaattatttttaatttccagtaaatctgtatttttctgattgtcctttttcttaatagtcttttgtgttttatagatacagtatctcatttaaatttatttgtgcattattaattagaattttaaaaattattcctgtgaattatctgtcctcaggtatgacctgtcttatatgttcctcttggcctttctttttcatgggtactgctttttcttaaatggctgatgattgccaaagctgattgtgttgatagttagcacaagtcccctctgtagcagtgtgggtctcattgtcttagaggcttttccactgaaggcagggctgactgcagactctgcactgtgaccagagtgtggctaactagcaggcttctgtagggttggcatgggtcttccctctaaatcttcccctaaggctctgaactgggaatctgaggcaactgggcactcttgctgttataacaaagatgcttctcttttaaaataagcctcacacctcctgttgcttcattctttcattcctttccttctgaacagacatgtgaggtctgagatagtatctcctaagtggtgcaagaaggcagtgtgcttgaccaagcctagggggcagaggaggcatccagaggagctggtagcaggatcaagatcccaagtgaagaaccacaaacagaggatagagacccagtgaggagaacctcctctcagtatggtgtctgaagcattggccagtggttctgagctatggaagtcatagtctggaatacagggtcaccctcaccagagtgacatccaacagatgaagctgtgcatagagcagtgaactaaacaatgtatgaggtatccttagatggtgcactcagggaggctgtaaaagatacaaaaggctttgcagtgattaggagaggcacctagtcatcaagaaaaaaggtcaaaatgtttaaaggatggaatagcagggtcagaaagagatgcaacaacccagataacaggtattgaggttgactatatgggaaacttatattagctctgcatcaaatatattaacacagggcctccttttatggcgttagaccagagcaagatctcaggtcaaagcagctcatcagaattgccttctgcatgtggtcataaagaagaacattgggcaggaatgcagtagtttggggcagagagctagcttatgaagatcatcttaacttgagaataattaaggaagtgtgtggttctcaaaggggtgagattatgattgcaagaaagaagctaacagacacagctgcaggaggtaatatttagttactctaagctggagacaatacagcatgatctcagatgcagatctgggtttcccagtaccccagagtttcccatgaagacatccagggacagaggatgccttcctgtggaggcacagtaccggaagctccccttggtattctcacagggggaaaggatggtttatgcccacctgccacctcccatcccccagccaaatattgatcatgagggtaagtctccctcagcagcccaggcttctgacctgtcttagctccattctaaattttatgagagaaggctttcagaagtctagttttatcctatagctaataatagtaacataatacgtgaattatgttacttcaggatcttcacttcttaggtagactgcttcaacactgcttactttctctccttactgctgactggcctctccccattcttattggcaccttcattgaaaaatcagctgactgtatgtgtatggtttatttttggactctgtgttatcatagctatgttttagcatttattaattctattatgctctatttggaaaactttccttcataacagctagaatgtgagcttcttgaggggtcagtttctatattttacttatttttacattctcaaaatgaacactcaatggatgtttgctaaatgatgaattagaaaaatagaattttgaattacttacttattagcaggactaattgagagttagctaagttaaagactgtgttttcatctggcacttcaataatctgagagctgtagaggccagcctttctgatatcattccagtccaaatttttagtgtagtaacaagccccaatgccaaagctaacaggaacagaatagtcactgtgattacactgaggtcaacatagggtagtaattcagtttggttggttgtatttttttaagggaagggaaaagagatgaagccatgacagtttttcttattgggtttcctaaaaaatagtgaattaatgcataattcagtaccctatgtgctcctaagaagtaataagagcctgaagttcaaattaactccttaatttaccggaaatatgttcactctgtattttttagcataccagaagacaaagctttcctttatattatgaaccggtcatttattctctattaaagactactctctcatgtgttagcgtctcagaatattcgtgtgctctattgtattttcgcatatcttcttcacagaagtaagttcacatgcattatacttggcagacttggtattgcccttgatgtgtaactatttgtgtgagtagagaatctccagctgccattatggagtcattaaagaaggactgggaagtggagtgtagcacatgatctagtcatttaagctgaccatggctgtatttggtttgcctaatgagtgggtatggcttcaaaatttgaaaaattacatttgattttatgcttattttcatgcttattttaaatccccctaaatgtaaggttcttgtaatggacaaatagaatttagagcttttcatgactcttgaccttctgtctcagtaaaatttaagaatttttaagaacaggtcgcaatgaggagtcatttagttgtaagggacagaaacccaattcaaactggccatagaaaaggaaataaattggctattataactgagagttctagggatatcccagtctcggagatagctggattcaggggttcaaagagatcatcaggcctttctttttcttgcttttcccatcctcattctcatatctttgcttttctccaccttctacagtatcaggaaggttgttgtcacagtagcaccagatttcgttatccatagacttcacaatccaagaggaagataaatcacaagctgctatggccaagattgttaagcttcctcaccttatctgggcttcacttttctttctctctctctctttttttttttttttttcttttagaggcagagtcttgctgtgtcacccaggctggagtacagtggaatgattataactcactggagtacagtggaatgattaagctctgaggctcaagccatcctcctgcctttgcctcccaagtagttgggactataggcacacacaaccatgcctggctaattttttcatttttttagaggtgagatgttgctatattgcccaggttggttttgaactcctggccccaacttcccaaagcactgggattctaggtataagtcaccgtgcctagcagtgcttcactttccttattggtagggtggggatggctgtcaagcctacctcataccaatggtgatacttgtgaaatgcctggaatagtgcttggtacatagtcaatcttcaataaacgttgactcttattatcatcttcactttataggaggggaagtttaggtacaagaataagaaaactgccgttccttcataactgattaaaagcagtcattactacctgggaaacctgaacaacattgagataattacagtgcctcatgtatagtacagcacatgtatagtgtgctgggtcatgccatcaagattttcacatatctgagatatgaacatgtgtctttcattctagctctgtatttcatctgcattaataactgtgtgcatttgaaagttattgaaaagtagtgttaggagttgctcatgtgattgtagctgtggttttatttgttggaataattatagttgctactgtttatacagagctgtgtgtagttactgccatttaattaactgtgtattgttactttactgaacactcatatgccaggtggtaactaatcctagggaggagtcattatgtacatttttactgatgaagaaactgaggcacagaaagtttaaattacttacccaaggtctcatagctgaactagagttcaccccaggtccacctgatttagaagtccatgcttttatccaccatgccctactttctaaggaagctatgagaactggcttacaaaggaaacgtgatatcagtagaagactggcatcatctggaggaaaggagtggaatgaccacaggcaggaagaagttaatcgagacttttgtgagaaaggtttaggttgcagaactcagtgtcttaaggcctacaattcaggttgaaggggagggaaatggagggcacacaatctcaggacatggttctgtgtgggaaaagaacatgcaaatggatgaatgaaattggcttctgataaggccaagaaagggggctgccaagagcgacactgatgggctgaatccaggatatgagcttcctgagaatagaggggtaaaaaatatgcaacgagtagcttataggtaagtggacaagtaacacacaatataaaggaacctttactagtgatactaaaaaaagccctagaaagttacagaaaagtgaaaagtaggtaataataaaggaatgtattaatgggatgaagtaaaatatattcgcttaaagcacactttcaaaggcactaaataataactttagtcagattcccaaggaggaacaaacttaagttctttggacaaggtcagattacggtgattgaattcatgctttagttttccctgagataacactgcgtacatcttaacatccttacgcagcattttccaaatttgctgaacatatgtaccagctcttggtgggggtggttaaaatatagatcttcagcctagcccgcagagattcagggttagagtgttgattatgggcatgtttgggaaaggctgccttaagtagaggtggcctgttgttctttagcatctccagatgtttttctctctccccaggtacacatagaacagaggccaaacgggtatacaccaagctctggggtacagtgctatgatttaacgggatgaatgctagcaggaacctttaaggtgttattgagggccaactctctggggccaattgaaattgagctcacttagaataggtgccttgcatttggctgacacttactcatgaaagtagtagctaattattgttagactcagctccttcctccctccctccctccctccctccctccctccctccttccttccttccttccttccttccttccttccttccttccttccttctctccctccctctgtcttactctctttctctctttctttcttcctttgtcttgctctatcactcaggctggagtgcagtggcataatcatagctcactgcatcctcaacctcctggcctcaagtgatccttctgccttggcctcccaaagtgttacgattaaaggcatgagccaccagctggcatacataagctttttttttttttttttatagaaaggataatactaagagtttaaaacattcactcaggttttaataatcaataaatatttgttattctttgccctcataaaatttgcagattgtaaacagggtgacttgtgctttcattaagacactaatgtcttaagacactaagcagggtcccctggagaagttttgggagaaaattggaggtagatgggctgtagggaaggcataagagcttgtacttttactaatcctaaggcagcagttatcaagtagggcttgtggatccctgggagtccttaggccatttcagagtgtccataggtcaaaaccatcttcataataagggcagtgagatattgtttgccttttcactgtgttgatatttgcatattggtccagaagcagtggaagggcaggggagtcaaactcctggcccctttgtcaaaatcaaggtggggcaccagactatggctaccagactgtgctagtagtcactgaatgcctcaccaccacacagtttttttttttaagacagttgtgtttagaaatgtctttgatgaagcagtaaatattattttgtcatctttaccctcaagaacatgcctttttaaaattctatgtgataaaatggaaagtacttacaaaaaacttgtgccacttgctaaagtacaatggttgtctcaggaagaaactttttcccatggaacattatttttgcttgaaaggactattgacagatgaactgattattcagacttgggtatttggtggaaattccccaaaaaataaatgaagtaagtgcatcacttcaaggaaaataattgacaatatttgttactgtattagtccattttcatgctgctgatacagacatagccaagactgggtaatttatacaggaaaaagggtataatggacttagagttccatgtggccaaggaggcctcacaatcatggtggaaggcaaggaggagcaagtcacatcttacgtggatggcagcagacaaagagagagcttgcgcagggaaacttctctttataaaaccaccagatcttgtgaaacttattcactatcacgagaacagcacgggaaagagttgccccacatgattcagttacctcccactgggtccctcccacaacatgtgggaattcaggatgagatttgagtggggacacagacaaaccgtattatttcacctctggccccttcaaatctcatgtcctcacatttcaaaatcaatcatgccatcccaacagtcccccaaagtcttaactcatttcagcattaactcaaaagtccacattccgaagtctcatccaagacaaggcaagtcccttctgcctatgagcctgtaaaatcaaaaacaagttagttacatcctagatgcaattggggtgcaggcattgggtaaatacagccattccaaatgggagaaattgaccaaaacaaagaggctatgggccccatgcaagtccgaaatccagcggggcaatcaaatctgaaagctccaaaatgatctcctttgactccttgtcacacatccaggtcatcctaatggaagaggtgggttcccatggtcttggacagctccacccctgtggctttgcagcgtacagcttccctcctgtctgctttcatgggctggcattgagagtctacagcttttccaggcacacggtgcaagatgtcagcggatttaccattctggggtctggaggatggtggccctcttctcacagctccactaggcagtgcctcagtagggactctgtgtggtggctccgaccccacatttcccttctgcactgccctagctgaggttcttcatgacagcctgcccctgcagcaaacttctgcctggacacatagacatttccacacatcctctgaaatctaggcagaggttctcaaacctgagttcttgacttctgtgccctgacaggctcaacaccaacagaagctgccaaggcttgaggcttgaggcttgcaccctctgaagccatggttcaagctctacattggcctctttcagccacagctggaatggctgggacacagggcaccaagtccctaggctgcacacagaacagggaccctgggcccggcccacaaaaccactctttcctcctgggcctccggacctgttattggaggggctgctgtgaagacccctttcgccctggagacattttccccattgtcttggggattaacattcggctcctggttacttatgcaaatttctgcagctggcttgaatttctcctcagaaaatgggattttcttttctatcgcattggcaggctgcaaattttccgaacttttatgctctgcttcccttataaaacggaatgcctttaacagcatccaagtcacctcttgaatgctttgctgcttagaagtttcttccaccagataccctaaatcatctctctcaagttcaaagttccacacatctctagggcaggggcaaaatgcctctagtctctgtgctaaaacataacaagagtcacctttgctctagttcccaacaagttcctcatctccatctgagaccacctcagcctgagtttcattgtccatatcattatcagcattttggtcaaagccattcaacaagtctgtaaggagttccaaactttcccacattttcctgtcttcttctaagccctccaaactgttccaacttctgcctgttgcccagttccaaagttgcttccacatttttgtgtatctttccagcagcaacctactctactggtaccaatttactgtgttagtccattttcatgctgctgataaagacatgcccaagactgggtaatttacataggaaaacggggtttaatggacttacagtttcacgtggctggggaggcctcacaatcatggtggaaggcaaggagcagcaagtcacatcttacatggatggcagcagtcaaagaaagagagcttttgcaggggaactccactttataaaaccataagatcctgtgagatttattcacagtcacgagaacagcacaggaaaaacttgcccccgtgattcaattacctcccaccgggtccctcccacaacatgtgggaattcaagatgagatttgggtggggatgcagccaaaccatatcagttaccaatgataaaattttgaacttccaagaaaaaaatgagagtttcggaaaacctctatctgcaactatgaacttcatagcttcctaatattttaaatattgagacaagatttttctgatgagattgtggtgatattaatgcatgtagttttaaatttttttgtgaaatgtgtccacattgggaagatcagctcattttccaaaaaactagtgcatgatgttacacaatcagtattcaaagtcgagactgaccagtgagtactttcttgtttgtttttagaccagtggattttattataacagagtatttaatgtaacaaagaaaggttcattgataggatttcaaattccacattacaaataacctttaagaaaccagcatctgttgaattttggtgtagtatcaaataataatatccacaattaactgaaaaagctactaacatactctttccctgttcaattacctatctgtgtgaggacagatttcctccataaacttcaaacaaaatattatattgcaacagattgactgcagaagcagatctgaggatctagctatcatctattatgccatacattaaagagatttgcagaattgttaagatgatgccactcttttcaagactttttgttttgttttgttttggaaaaggtagttgttttttataaagcatgctatttttgttaatgtcatagatttttctttttaaatgaattaatgaacatttaaattttcctgtttttatttctaatatgataaatattgatggattataacttacagaaagaaaagcttcgagtcccttaataatttataagagtttaaaggggtcttggaaacagaaggttgaactgctcacccaaagtgtgactgattaaggggacggctgcatgatagccatctgggcctcctgagaggactgcctcttttttttttttttttttttttggagacagagtctcgctgtcgcccaggctggagtgcagtggcgtgatctctgctcactgcaagctccacctcccgggttcacaccattctcctgcctcagcctcccgagtacctgggactgcaggtgcccaccaccacgcccggctaatttttttgtatttttagtagagacagggcttcaccctgttagccaggatggtctcgatctcctgatcttgtgatccgccggcctcggcctcccaaagtgctgggattacaggcgtgaaccaccgcgcccggccaggactgcctcttaaagttcatcttttcagcctgtaatcacaaaaagaggatctaggttctcccatctcccattagtagacccagttcctaccaacccataccctaaagtctgtcgtttctggggcagaagcaataactgagcatctccttgatcaggccacaccctgtctcccatatttttggatttatgtgtaaataagacagttaaatagagttctcagtatttttccaatgagaagctgctttcaattttgacacatctgacattgatcacatagttttacagaaggttttaataaagttgccaactgtggtctttggagtctgacaggctcacctatttcatcgccttatgactttgggcaagtcatttttatctctcacagcaacagtgttctatgtatgaggaaagactgggttcacaataagtttaatgatggtgttgatacttactaggtgtgttaacagttttaattgttattctccctgttcccattggcaattttcttgggcttggaggtttgagatggcaatgagcttgactagtctatttgtaaattacagctgaattgactgcagactcctgttagagaaagctgtttggctcaactattggattatatacatatttttataataaattccatcttcctatacacacacacacacacacacacacgtacaaagattgcacagcaaagccagcataaagtgatatggcatatgatcagtcataacttttagattatcagctaatttctacctgacccttcaaaaagccaatgaacacgtagatgtcatgctagtgagaatggatagctttcaggaaaagggtaggtcctttgggactatctctattcttttgaaaacgtgtgccatacttttagatgagaacatataaataagtctaaatcataccagacatttttcagaattgtccttttttactaaatcattctccatgtgctaattttaaaatgtagttttgatcttctctagtttttttctgggaaattccttctctgttgaaaacagagcattgaaaggagaggggacatcattgctttcttgggttttattccccattccatagagatatcccttgacctgtgacactgtggctcctggaagatttgggaattgttattgcatggggttagggggtctttatgcacaaatacatattctcaaaggacactgaaagtataaatgtctttaggcggagttagggagtaaatggcattaaaagggagtcttaaaacttgaaaacagtctcatatcacagtagtccatgcaacatgaagtcacctctggtatatccagcccctacttctggaccgcgccccaggggcctcctctctctctgcttgttaccttttacgtttattcacatctcttcagtcatccacctagagtagactgtcttgcttcaaactgcccttaatgattggtttagggtatatttgcttcttctccccctgtctccatttttgacattatcatctttccttaaagaccacctcctcataccactttttacttatgactaagccctaaaattaatgaaatttagaaactggaaagagaaaatgggtaagtgcaagggtaggacacactgctttggagaccatttacctaaatttctgggcgtgtgtgaaagcttgcgaggtacttctatctcatggagcacattgtttatattcgcattcatgcacataaatacctcaatagtagtgaggcttcacgtgcattcagtcccattctcacagtacctgacattcttccattgtcttcttccaggctatttgggcacatggtttgcttctaatgaatgtacctaatacttgtgttcggcttaaaattaatcaacaaaccttctgaaatgcttgaagtaaaacaaaatactcttttgataaagccatactcctagaccattgaaaacacaagtattgttcaaaaaatcatctcatagaaaaatgccattgtagttaaactacttgcttgctggggatagaacaaggacataatccaagtggcttcacttgccgtcactgattttcttccatttattgtgcctgtaaaggactcaggtttggttgaatatgatggaattatttcagattgcgttgctagaaataatcctggtctgaaaaacctagacatgcactataacaatgtccctgtctttttagtaaattagcaaattaaaaaaaaaaagagtactttggatccagtagaggaagtaggcaaataaacagtacacctatcaagactttcttatttttttttttttttttcttgagacagtctcactctgtcacccaggctggagtgcagtggcgtgatcttgactcactgcaacctccgcctcctgggttcaagaaattctcctgcctcagcctcccaagtagctgggattacaggcctgcgccaccacacccggctgatttttgtatttttagtagagatggggtttcaccatgttggccaggttgttctagagctcctcaccttaagtgatcctcccacctcggcctcccaaagtgctgggattacaggcatgagccattgcacccggccaagccttaacttttgtatattaatttaatgttcttagttttcgttgatagttaaattttatgtagatggttgtcatgcataaggcaggaagaaatattttctgtgcaggagtgaaaataggctagagttccgttgcgtgtgtatgtgtggggttttttttgtgtttttgttcctttgtttctttgttttttgagacagagtctcactctgttgcctaggttgcagtgcattggtgcaatcacggctcactgcaacctccgcctcctgggctcaagtgattctcatgcctcagcctcagctgggattacaggcatgcaccaccatgcccggctaatttttgtatttttagtagacacggggtttcaccatgttggccaggctggttttgaattcctgatccgcctgcctcagcctcccaaaatgctgggattacaggcgtgagccactgtgcctggcccctttttttccttctgagacagggcttgctctgtcacccaggcaggagtgcagtggcacaaacctagctcactgcagccttgacctccttgggctcaagtgatcctcctgcttcagcctcgtaaatagctgggcccatgggcacgtgccaccaaccctggctattttttaacgatttttttgtggagatgtggtcttaccatgttgcccaggctggtcttgaactccagggctcaagtgatcttcctactttggcctcccaaagtgcttggggtggcacccaacctagagttctgtttttgatctttatcatgcatatggcttaatcaggtttttgtatgggggcttattcatggcattcaggtcaaatgagtgttggttctctgcactgtctttagtggtctttgccattttggagagtatccgagagttgtaagagacacttaaaaactccaaaagtatctgagagtatctgaaatacataataaatgtgtttattagtaaatgaggaaatatttactgagtacctaatatgctttagctagttttagtaactatagccaacaaccatgagttttttgaaaattaattttttgcatgttattaggtgttagtaatagtaaattttacaatgttgcttttgtttttattattaatggagagcattagttattttttctttccaaaaaaaactgaattgataaaaaagtatcccttctctatgaagtaatttgttctccttttatgaagtaactcagtgatctctttatttatgtattgtaaccatatgtatgcagccagaagttattcttctctaccctccctcccacaactaaacagctttgggcagcagcatgcaatctttttgctattaagtttctatgaagtgaggccagaaagctttaaacatattttgaccaagatggtttaggagtctggttatgtctcagtttgctctgactgacttgactgaataacatcttggattgtcaacgaagtgttgtgtaatgtgtgttttctcacacttgagctcataccacaagatattcttaggctaataaatgtatctcccagccagtgtaaaatagagaactttcaatttaggagaagcctccctgctcagaaactggtctccctgtcttagatttttaccaggacatggtagattcccgtcctttttttttctcctgaggcttggacttgctcccttttttactattttttgaaattttccatttaaaaaattaattttgtaaaaattttaaacagtttccaagttaccaaaaagttgcaagaacagtgcaactgtcttttgcatcccgaagttttggagagtaagttgccaacatggtgcttcatcatcctcaaatatgagaacgacattctcctacataacccagtatgcataataacatcaggaaattaacattgacttttcactaccgtctaatcctcataagagaggcctgtgaaaactagtcaactggcaaaaaaagaaaatttgagtactgcattgtagaaaaaagatcatgataattctcagttgagagtaggtataagtgtataataccagaaaaatatgtacacttaatgtaaactgaatggcaaatgaagaggcaggagaaaatgatcatgataatggggctgctgtccacatgcttctctagcaatcccacaatgtgtcttcattcgctttgatgctgaatacatgagctcttctatgacgaatcatttgaccactggatagctccagctttgagtttgcagttggccctggtaccttgtctcaaagtcagctattttggtcttgttggtctgcttcttgatgtagcttctgagagtttagttattcagtaccattgtagaaatttcagtacatcagagggattctttcatgtatgtgggttgcagctgcccactgcactgtatagatggtctcacatgagtgaatgtccagccttattgctctgttgctgaagagtgagagaacttgctctctgtgatcaaataggctactttttcctttcattttattcctgagcaaataatcctacatagagttcttcatgtaatttttctctgatttatattataaagtgccatggtcaaagtggcattatgttgtgaaatagataagctaaagaacagttcttcatagaagaagtaaaaaggcttatcaataaggctagctctttgaaagaactattataggaaattaaaactttttctggtaagtttttaatgtacatgtttatgtaaatgtggattaggtttaaagttttttgaacatttaaagaaattcgagaaaaaattcacacatcctatcaccttatcaaaatgacttaagttctttgttgtttatatgtgcatttgtataactattacaataaggacttatttatattataagttatacatatagattctgattgtgatatatgtcctttaaggctcttgcagaccaatttgaagataaaactacatctgtattggaacgcctgaagattttctattgctgtcaagtaccacctcactgggccattcaggtatttctgttgtttgtcattgggtatggaaattacttggcattagaaaggtaaatgcattataaattgatgattttaatttatgtttgaattttcaaatattttgctaaagataataaatgtatctgcctgggaattgctaactacttcaaattgctattttgattaaagtgatattagactcataaaacatttttaaaataatttaaaatcttatgaaatagaatcctagaaataaaataatagaatcataaatgcttgcattttgaaagtaacttctttttttttaagggatgaggtcttgctttactgtacaggttggagtgctgtggcgattcacgggtgtgatcattgtgcattacagccttgaacccctgggcttaagcaatcactcttgcctccagcctcctgagcagctgggactacagatgtgcactaccatgcctggctttgaaataatttcttatattaaaattattttaaggactttctgccaaagaaggaaccttttaaacaagttgtttacaaaaagcaaaagaaagcatttatttggtatactttaagttgtgagatacacatgactactctcctctttctgaggctatgagaatacctactgtagctcctaatggcacatggtggggtggggattctggccccttgtctacatggttctcctgtattataggtgtagttccctattttgtaaaattttagcactgaaaataacttaagacacctgacccagtttcttaatgttacagaggagaaattgaggctcggtgcaattagttttctggtgttgatcacccaatctacatgaactaggtttctagtttcctcacttttaatctatctcttttccttagcttttcattgggttgaaattataccagctaataacaaccaacttttactgcatacttaatatgatgcatatattttattctgcattccacacatattctcttattttattgcaacaatttttaaaaatatctgttttacacgtgaggaagctaagtcacagagaggttaagtggagtcagatggagccagccaggggattacagatgatttatctactattgttattttaaccagttttctgtcctctctttcatggatcatacacataggtagtgagttagaaacataaatgccaacccaccatccaatcgtttaaaatccccattataagacttcttaaagtaggttatattcttaaacacagggtgaactaggaggtttattgtgcattggagttcagtttacatattgaaggaatctcaataaaacatatgcaagtaaaaaagctttatgatatctcaaaaggaatagcttcttcatcaagaatgtgttaacagctggaattttttagtgtgtttttgactctgatctgtgaaattggttaggtgctttatattatgtggtttgatggataaacatttcagactgagctgttatgacaaaatgtgtctattgagggtgttgctttttatctttttctgaacagaaacattaggaaacaaatactgttcaaactgaatttaggccaaatgcttatctgcctaggaagctgtagatttcaggatcttcaggcagttagataaggatcatttttcattaagacgttaattactttttcttgcatcatggggactatctttgtgtattattttaaagattgagaaataacagaacagtttattataaaaagagaattagtctctactttgctactaactagccatatcatcttggatgtcatcaactttcttcatctgttaaatgaagatattgtactgctcactgcataagcaccaagatttattccagctctcacatgccatgggcagtttttgaaaatgtccaattatattctctaaaatagccagattctcctgtattccatgggttactgatgtattggatcattctcattatttattttgataatctgtagcttataatttttaggcatatttctgatattatcagtcctagatttttctggacttaactcttaaatatgtgttgaattttcagagtagtaaaagtatacttaagagagaacaacacagctctctctaatatgaaactacactttattctgaccttacctacttttttaaatctttaaattttttttccctttgtgcaggtgttaacacttataaaccacaatatatttatttttaaatatgtttaactttcactgaccttaactcagtttgctcttttttttatctgccagggactgggaaattaggtagcaaagtttgttagaatgtgcttgaaataaatctaagtagctttgagtgagaaagagctagatatgcccttctgaataaaattcagcagggctaatgcatagattttatgtcatctctattgactgctcagagttttaaaaattaatttattggatctcagcctcataagttagagattgttatatacagagtgtctaggtaaaaaagaaatatttatttttgctttttaagttcttagagaaaatttgtatatatttagcattttcaacaaaaaaattgttctttaattccttataccctataaagaggcttgttttctaaagtaaaggtatgtattgaattattacaaacttctaaatagtacagattgtagaatttatacatttattacaataagcagacccctaaaaaggcagattaggtacacctgcaagtgaaacaggaatctctttttacaccaagaagtattaattatttttacttgatttttctagcgccaacttgcaagtttgctctttgagttgggatgtaccagttcagcccttcagatatttgaaaagctagaaatgtgggaagatgttgtcatttgttatgaaagagccgggcagcacggaaaggtatgtaatagtccaatttgatgtactggtgagagccttccctctgggagcatcttctcacttgttttgtttttcaaacccacttttgccaatattcacttatattccttttttcactttttttccagaaaacttttaaatgttttctctgatttccactggggcagatttttacaaaatttttaagaaagactaacaagagctttgaagacgtgggattttgatttctttcctttactcaccttctcccttaggatgacttcaaagcgaaatatttggaatcattttaatgatcactgggttgcctgatgatcagatgctgtgggcctcaatggaggttccctaggagagagggtgagagcagctgggttggtctttaaaagaaaatccaaagggtgtgacgacacctcttgaggcagaagagttgtcaagtgtgtaatgcacatttaattctacccttaaattgggccaggagggaaaatgttgcaatatttgcatctgttatttgtctgttgtttttttcccctcatacatgaacagaattttaagaagaataaggggctctgcattgttagtcactttaaaaactgacacattgaaatcatatgttaaattttggattaaaaatttaaaagacttaagttgagtacataagcaagcagagtaaagcccacaaattggatcatttatacctacagtcaaccttttgccatcaccctaaaaaagagcaatagtggttcaagcatgtgtttttcttaaataccttcctaagtatgtctattttagattaatagtgaaagttgcatttctttcactaatcagttaatggcagtgaaggtctttgaattgtattgacttaaggagaaaccagaataagaacaaagttttactgtggaagattatcgactgggcatggtggttcacacttgtaatcctaacacctcgagaagctgaggtgggaagatcgcttgagcccaggagttcaagaccagcctgggcaaccaagtaagaccccatctctacaaaaaaacaaaattaaaaaataaaaaattagctgggtgtagtggtgcatgcctgtaattctagttacttgggagactgagggaggatgatcacttgggcctgggaggttaaggctacagtgagttgtgatcatgccaccgcactgcagcctagacgacacagtgagaccctatctcaaaaaaatattgatagagttataatatttttatcctggaaaagaaccccataaacatccattctagctccctccttttgtaaatgaggaaaggtttcccttatgatttgcttcagatcacaagctggttattgactctttacttgcgaggtagtatggcatggtggctaaaagcatatagcctctggtctctggctgccggtagtcaaatgccagcctgcttcatgctagctttgtgatgttggacaagttgctttaatcttccttgtcttagttccctcatctggaagcacttaatctatttgccttataggtttttgtaagataatatatgtaaagtacgtactctagtgcttacctcataatgtgacatgagtgcttgctgccattacttgctgtgattctacgagatgttttttcttcatattttaatatctctaaaattggaatgtatttaacaattgatggcatcttccatttgctctaattcaggtggctgtcctgtcaggttgtccatacctgtgcatgtgaaagctaatgatagctacatttaggccaccatttcagttgagttgtggacaaggtgtcagcactacgtatgttgtgtttaattgccatttaaaatatcttcaaaaggatttcattatgatttggcactgaaacaaaaagttattgaatacagagaaaaagacagaaccaaattagagaaatgaaaatttagtattactgaaataaacatttgccatcagataaatcatcacaattccatttacttttctttaaaagcagcaaccaagtgctttatgagagtcaagaaagaaggatacccaaaagtagatgaagctttgttttgtactgagatgtatgaagaaaggttgtcatttaaaatgtcaagcaacgtattgaaggcaggaagaactgccaaatttttctgaatagactgaaaaaaatcaaagcaaacaagaggcattagattataattaaaagcattttttctttctttaacagagtttgtcttacaactgatagcatctcaaatttgatgaaatatagtcatgtatttcttcagcgacttaaatatctttttagtgcccgttgtctgacactaaagtagtactcagatgtttgtttaacaaaggaatgaatggatgaatgaatatcttgacttccagtctgatgtagttcccattgcatcattctttactgtgctagtctttttacactggccaagaaataagtaataactttatataaaaatatggtagtttttgaaataataatatttgaaataagcaagttggtaaatcacaaatgctcaaagcatattttagaatattaatttaattatttttagaaagtatggaaagatgagactttccttaattgcaggagaaaaaacataatgaatccatccccttcagagaagggatttgactgtccccctaagtagttgtgatgattattatttttttaaatgtgcacatgaccttgtaagaattgtgtgtaataatgacaaatgcttctgtttctaaatcctctagaaaatgtgcatatttaaaattttagaaatgtatagtcatttactttgtcttaagttttttgtgagttttagccaaacagcccccaaaatcttgatcttaaaagttgattttagtattttatttaacccataaaagacctcctttacctgtttttcttatgctatatttgcagattttttaaaccatagaccctaaaaagttttgctgcaatttagaagcaaatgttttatttctaaaacagctgatactcttttggtatttggtcatgtgccagtagctgtcaccacattttgatttaactagaagtctgtgaaattttaatccttgcatttaatgcttaattggcataatttatttttaaaaggcaaatttggagaaatgtttaattctaattattgtgttctggtgctcatgtttacatcccggtgttgtagggtctcagaaattctagcttagaaactaccggcatacattcttgttatttaatgaccataggcaaaatagctaagattaattttgctcgaccttggtatcagaactggttctcatctgttagcatttagtatttaaaggttatccgacccacttacagcaatttcccctagctgatagatgtattcttattttgttgagcaaatttggttcctaaatgagagacaaagactgagggtgaggggttagggatagataagggttgggacctctcttgttttctcttgtttcaaggaagcaaggcttccctgagattacatggtcctatcttttattatgctacatttgcagatcattgtaatcatggactcttaaaaagttttcctttaaattgtaagttaatgttgtatttctaaaacagctaagacttttttagcaattggtttggatttcctgttttgggggctttttttttttctatcatagagattctttatacagtttaaaagattttcccagaagttctttcctcaaactatagccagaatagtcttcctaaagacaaatctgccattctcaccccaagtaacttctctctgtttccagggttaagtctgagctgtttcgaatgagtggcttacagacaactttatttatttatttatttacttacttacttatttagagatggagtttcgctcttgtcgcccaggctggagtgcagtggcacgatcttagctcactgcaacctccacctcctgggttcaagcgattctcttgcctcagcctcccgagtagctgggattacaggcgtgcagcaccttgcctggctgatttttgtatttttagtagagatgagggttcaccatattggccaggctggtcttgaattcctgacctcaggtgatccgcctgcctcagcctcccaaagtgctgggattacaggcatgagccaccgcacccagcctcactttatgatctgtctcctgtttccattgccaactgcattttctccttcttttactccccttcatacctactctgtcatccaggttgcacctgaagttccagcagtactttaatagcttgaattaaagtacttgtaagttcttgattttgtagcgccgtctcacttcagacctttgtaattgttgtctgtctagaacgtttgtcttctttcagctaactgctacttattctttaggagattgctttctacagagagccttcccagatactttcctcccacatttggtggtaccatccacctgtgtactcctatggcacccaaactactctggtaccccatttgttggctcatctgatctactaaatgtaagctgcttaagaaccagacctgtgtcaacagctgttggccaggtgtggtggctcacgcctgtaatcccagcacattggtaggctgaggcgggcagatcacgaggtcaagagatggaggccatcctggctaatatggtgaaaccccatctctactaaaaatacaaaaaaaaaaaaaaattaaccggacgtggtggcatgtgcctgtagtcccagctacttgggaggctgaggcaggagaatcacttgaacctgggaggtggtggttgcagtgagctgagatcacaccactgccctccagcctgggtgacagagcgagaatccaataaaaaaaacaaaaaacaaaacaacaacaacaacaaaaaaacagctgttgccccagaacctggcaaagttttggcatgtagcaagaagtcaatcatatttgctgcatgagtaactagtaagtgatcactcaatagttatctcattgaagcaatctccatgtaggacactccttatggatgactgcatgtggcagaagatacccctccaaccactgccttactcttctctctccaaaaacaaattatgagattcccccactcccatttgaaccttctaactttaggagtagaaataggaacaaaccttaaagaattttgattcttgctcagtaaatgctaaggaaactgtgagcatattattatgtaatgctatcttttgagggccttatatgtactgcattctttatataattattttataattgtcatatgctattcataacaacccacaaaatatggattgttttcatcactttactgattagcattactaagtggcagttttggaatatgagctcagacctttatttcctttaaagccagcacccatttccccacaactgcctcccatcatggttattgttaatcccttaaaaattggatattagctttgtaagttaaaacctgttgtgctcacttgattgagaaaaataggcaaaataatggaaaatactctataaattggtaatgcaaataagagatgatcaactaattgaataataaagcctgtttttaattactctgtttcatcttggacctggagtatttatgttggcaagtaacctttaaaaaaatcaagccagagcatggtgttgtcacacatataactgtgaaaaacaattagtgaacatttggctccatgagagagtaagtaggagtagacaccactacacagaagtgtagctgggagtgtctgatgggtggggcaaagtgttttgcacttgtcacctctcagctgctgctcatagaataagaatttagactaggagtaaattgccattctgctaaaagggttgttcttggtgagagggaaacgtgctttggagttctgtcagctgtgcccctgtcatctttatgtactgtattgaggacgtagagcacctttcagtggtcagtctccctgtcattgagaaacagcctctacaatagaatcagaatccattttttgctctctgcttcaaggtagaaggctagaattagactatggccaatgttttgtgagtcccttgtgtgtgtgtgcgcacacactttttaaaaattttttttaatcctaaagctattgtcaagatgccaaatctggctaattggggaaccttaaattcttagcctgctttttctccattctcttggagcaaacctgtatttattaagtctaattttgctcttcatgtggtcctcaaagatactcttcatagttggtgccatctctgggtctagagcttatttttttccccttcattttttacgtggagggcttcctatagttgttggtctgccaatttcccttcctaatatactgaccagttgcaaggtcagataagaaccactcttatcacacattagaattttaattctttccattaattcacaaaatttccgctaattcacaaagttaaggcacagatcacagccaaaaagggtagtttcattccttctcactcaagtatgaataactttcctgaaatattttgtctaccttttcactggaggctcaacttaatttttcacccatattctttaccccaaacccaaggcttcatccctgacagagtgcttcctggaatcctagtggtgcttagggtaggatcttctctcccacaaatctcaaatttcccatataacaacttgcagaaaaaccatatcatcataaatataaatgagccccaatatagcaggttttcaatatattagttccttttcttgcacatacctgaaattctcagttctcaacactggactgttctatcgcaaaatacaccatcaggatggggaacccctcaaatacccaaaatcccccttcaggccatcagttttgcttctctgtgtttatagtcctaagaagagttgcttcctagttctcatcatttggttagaagggcatgtgaaattcagattctgctatatgacctctctattcactagggtaaatttttgttagatctctcctaatttagtcatgtagtgatactcagtattgatttcagctagagtgtgtcacctaaaggagttctcctgtcgttcccaaatgtgaaggatcttttatgtttctgtttagtatctgaaggaccttagaaaataccattagccctttgtgactttagtattagttccagttgagttcatccaatgtttatagactacctactgtttgctgggtaagaatattccaaagatgactaatagacaaacttactacaaacacagttatagtccgatatgatagatacacatgagcaaatattttagtatgacagtgctaagataaaagtatgtacagattccaaattctatgtggctctcatatttacagctacataattctttctctgctgtcctgctctaaagcagtgatctccttggtttgtatcttgcatagattcctttctgagatttttaggactcctgtgattttccacacttttaataaaaaatccaatgtttggtggaaattagccttatgtggaaaaatttagttttgatcttctactattagtaatttttttctctttgacctcactttcttgattcttcttggctaagttctgtaatcatctatttaatgttgacaacagcaatttttctgtttttggagaaactacacagttgaccagtgtgattatttatggaaaatattaatgttcctagaagctctttcaagtcccctcttcctagaggtagggcaacctcaagtgtcttgctttccagtctggttttctaatggaaggagttgaggaagaagataaacagtttagggcttactgcttctttcaacctctctgaggtaggtaagccaaaaatgaagaagaaactctcaaaatgttagtttagcttgttcatggtcattcatttagtaagtagatttgacatttgaaatatctgattaaaagcacatacatccatggccgggcgtggtggctcccgcctgtaatcccagcactttgggagacctagacaggcggatcacaacgtcaggagtttgagaccagcccgccagcctggtgaaaccccatctctactaaaaatacaaaacttagctgggcatggtgatgggcacctgtaatcccagctactcaggaggctgaggcaggagaatcctttgagcccgggaggtggagtttgcagtgggccaagatcacgccactgcactccagcctgccagcctgggcaacagagtgaactctgtctcaaaaaaaaaaaaaaaaaaaaaaaaaaagcacatatatcctcacagatcttcttgtagttggaagtctatagactagattatgcaacacaattttttagtaatatgttaaaactattttggttgtaaaataattaacacatactagcttaggcaaaaaaggatattttattggttcttgctactgaaaattctagtagacttcgcatgagagctcttccaggggctcagatgatatcatcaggactttttagctctctccctgaggcagacatgatggccacaggaagcccaagtttagtaatctcagtggaaaaatacagtcaattccacatctctaaagaacgattcagtggaagactgaagggcttgagtcatgtgccttctgccatctcatctgataggaactacctggaccacacatgaagtgggttttcctcagggaagaggagtttaattttcagaagatcagggaagggatgctgagcaggaaaaaagcaactgtgatgtccactgtggggtgggagtttaatgacctaaatctgaagttgcaaactggcagcttatgggtgaatataggccagagagacagtttttttttgcctaactcagtattttgaaaaaaaaataataataaataaatattttaaggatacttcatcttaaaaaatctagacttcttggcctctcttaaagagtttaaagatgtggaaacactgagcagccagagtctcatgttggtgtcctaactggctggagctaagcagtggctctttcctttggatgctcatctaccagcccactatattcatctcaaaaattggcaagcatctctgggcaatttagggtatgacctttgctctaaatagtgcaggtttccctggtcaagtaaacagcatgttactccggttataattacaagttctgcttgagtcttggccaacttagttttgtgctgagatagtcattgccaaaaaaaagtattaaaattaataattagttgtgtggaattactatagattgttgaaacagcttagatttgtatgtatgtggagcgggggtaatgatctttggggtttgcatctgaaaagattcttgcaagcgctgcaggttcattgcaaccagttgcccatttaaatatgttttttttgtttggggaatgtatttttattatttttaatagacatttagatataaagtttcttgcatcctataagaatgcacatctggccaggcacagtggctcacgccggtaatcccaacactttgagaggccgagacgggtggattacctgaggtcaggagtttgaaaccagcctggccaacatggtgaaaccccaactctactaaaaatacaaaaaattagccgggcgtggcagcacatgcctgtaatcccagctacctgtgaggctgaggcaggagaattgcttgaacctgggaggcagaggttgcagtgagctgagattgtaccattgcactccagccttggcaataagagtgaaactccatctcaaaaaaaaaaaaaaaaaaagaatgcacatctgtatattcccatggggaaatagtaaccaatagccagaaattctaaagcttttgcattctgtgaagatttatggccattcacattttgatattgcagaagtgatgttatgtaggccctggtactttatttatgttcactgggcacatcttttgtagctcattatttggtaataaattatgtaaattgagtggataagtggaggaagacagagaaaacagaacattttggaaagagtgaagaagactgaggaatgcaatatgactagctgaagaaaggaaatactgccagcattgcccttgggaaagataattttgttggcagaaagaagaggtataagatctcagggagaaagaattaacttatctaacacaaaaatgtgggatagaatttgaggaaagaagaggtcagttcagaccaagcagggtgactgctctagtgtttctcaccttctctggaaagttacacactctggcccttcagacccatcttgcagttaatagaatatccagaactgatgttgggtagcaacaagttacacaccatctattatgttcctcattcttaaaagagttgcggtgggtgggagttggtggaggaaatatatgaaatcctgagtaccctagcatttccaaatgtgaagattttcctgattatgatttcatttttcatttgtatacagatgcttcttgacttacaatggggttacctcccaacaaacccatcgtaagttgaaaataattgtaaatctaaaatgcatttaatacccctaacttactgaacatcatagtttagcctattctaccttaaatgtgctcaaaatacattagcttaaagttgagcaaaataatgtaacacaaaacctattttgtaataaagtgttctgtatcttatacagtttaaagtgaaaagcagaatgattatatgggtacttgatgtacagtttctaccaaatgtgtattgctatggtaccattgtaaatttaaaaaattgtatgtcagaccatcgttaagttgggaactgtttatatttattttgtcttctttgcaatggttgcagaatactaggtattaaactctggtaaatcatcacaatctatactatagtatagtttgaagtagaataaatatttgtagaatggtgtttttaaccaagcagattctttgagaatatgatttgatgtctgagccttggatcctgttttcagcgtaggatacctggggagtatagtatttccctgtaatcctttttatttctgtaagattggtagtaatgtctccttttctttctaattttagtaatttgattttaaagatttaacttttggttttttgattttctctattattttttgatcctctgttttttaaatttataccctaatttttatttcctttcttctccttgctttgggtatagtttgctgttctttttctagttacttttggtggaaggttagattattgatttgagaacttttttttcaatataggcatttataggtataaatttccattgaatcaggcttttgctacatcccgtaagtttcagcatattttggttttggttttgttaatctcaaagtgtttttaattttgttgtaatttcttcatttcattgattatttaagagtatattgtttaatttccacaaaattccttttgttattgattttgaattttatcccaattgtggttggagaacatactttctatgacttcagtctttcacatttgttgagacttgttttgtggcctgtcgtatagtatatcctggagaatgtttatgtgcacttgagaagaatgtgtattctgctgttggctggagtgttctttaaatgtctgttaggtctagttggtttatagcattattcatgtctacttacatcttttgtgtagttattctgtccatttttaaaagttaggtattgacatctccaaatattattgttcagttgtttatttttctctttagttctttcagtttttgcttcatgcaatttggagttattttagctgcacatatatttgtgattgttatatctttcttgatggagtaaacattttatcataaaaatgtgcctttgttctaacaattcttttttttttttttttgagatggagtcttgccgtgttgcccaggctggagtgcagtggcgtgatctcggctcactgcagcctctgcctcccaggtttcagtgattctcctgcctcagcatcctgggtagctgggattacaggtttacgccaccatgcccggctaatttttgtatttttagtagagacggggtttcaccatgttggccagactggtctcgaactcctgacctcaggagatctgcccgcctcagcttcccaaagtgctgggattacaggcgtgagccaccatgcctggcctgagttatattcttaatgcctgtaccagggattacttaagatagttgattttaagtctttgtttagtaagtctaatatctgggcatcctcagggatagtttctgttgattgccttttccctgtataaacatactttcttgtttctttgcatttgtttgccccaactgttatttaccacctcaggcagctgcaaaattaatcagtcatttctagttgttttttgaaagacttttcactgaacaagcttagaattaggtcaaataaagatagtcttgcaagtgagcttttccagggaatcactagactgggcatatgatgacagttttccagaaatgcagctttaaaggtgtttcaaacccattctgccccctccagtggctgccaggccactagttttcacgaagattgcaggctcttggtattcaagactactacagaactggagaagaggggattggaatggtacaagttaaaatgccatgaagcttgctcttcttaccaagatttagcatttctcttgaataaatgcttcctgtattattgcaagtctttggttaattttcagagttctgaaaaagttggttctgacacttttggccagttttctggttattttgtagtggagggaattttcagatgttcttataccattacatttgctactgtctgcctgtggaatagtgttgaagctagaatcaagttcctgctttttaacttagtgtttcttgggttttgggtggccaattgactaagaaatctaagcttttatttctttctctcaaaaatgggcatgttaatatatactacttggaattattgtagggattacatgagatcatgcatttaagaatcaactggataaaagctaacctatatgttactaccaaatggaaggatacataagttcaaaaggtagaaatgggaaaaaaaaaagattttatcacttaggcctgttttatggaagcagagccactttgagtattttagagaataagtggtttactaaaggagttgaatcttaacacaaatgtgagaagagctggggaaatgaaggtatggaagagggaatcagaagatcaaggcaagaatcattgactagtccacttgaaacattggcacaagtgggtaagtcagaacttaaggtaaatccaagaagccaaatactttcagacattgaaatgggaccatgaagcaggggcttgtggagggatctgtggacaaccattatatctatatagctattaaccctgtgagtccacacagcaaatgtctcaggggcctggggatgctataggtcagcagagccagcagttggaaggacaaggtatacacacagagcatgggttctgggatctgcagagcatctccacatcttgtttgttaccatattagaccatgacaactttccaagagtaaaggctgttgcttcacttctgcctttgaaatccttgataggttctcctatgatgaactctaacatgaaatcagaaggaaaagggattttaggaaacagtttccagtttaagcaagttgacatagcataatccagtacatatgactatgcaagggtttagttgtttaacttgggaatttacttatttggaaagtagcaacgtactagcaggtacagattattccatagattgtgtttcataaagaagagtttctgacatggggaaactttaaaatttcttcaaacgggggtttagatattgaagcattcttacaacatataaagttaaatatttaatttaacaaaccttgatttgtttaatagatgaattccttaggggtgatacatcaaatggatttttgtaaattcaacatttccctaataacaagtattaataccagctatatgataatttttaattggttttcagttgacattggcacagaagttttttaaatcttagtttgtgttttgttagcatgatgtcatcaaggccatgggatggtgagacaatcaaagtcattgcagattaaattatatcataaagtccatgtggttctgaggcaagataggacaagcatacttctctctgtgctggtaaaaggctgctatatctggtgttgtctggttattgtgtagagaatagcacatttgctgtatcagtaccctgcttcccatgtaatgatttattccagcaaagagatcatgtccagaacagtagctgtaatcagagccaccactatgttaagtttatcataatccatgacattttccaggacccatttttgttctgctcagtttaaatgggtaggttaaaccacacacacacacacacacacacacacacacacacacacacacatgcacacacatatacacaagtttttgataatgacaccaacctctggtttactagatatgcagtgttgctttgagtttactcttttaatgagaagagtatgtacgcttcaggggcttttgcttggccctttttactgtagtagcacttagtagaggatctgctggttgctcaatatatctaattcactgtacactcacagtgaagggaagagaaggaaactagagaaatcaccactagatagattcaggcccagattactgggcctaccatgggatggacagactttcattaacccaaccactcatcgtgatgatgttttgagtcccaaagggttaacattaaagaggtaaccctaagaagatggggtatttctatttccccaggatacaattatgtggcaaatatttatgtttacttctttggaaaatactagggaagagctatgatatatccttgttatgttatttcagagtccttcctgaatggtattggcttcttgtttatttttatctaaaaggctgtgagtctttgaagtgattcaaagataggaactgggtgagagacaatgtcttatcatggagactcaggtcaggcatctggtctccaaacctagaaatttttttctttaatgttatacatatcaagtttgaacttcatcagctgcccatctagtttggaactgaagtttcaggatcagtcagtcactacttaagatccatgctagtctgacctaaatatctgattatcactgtggccatgctgattgcaaataactatgctcataatgcttccaggttcagtgctatcagcaagtctctcccaccctgggttctaaccacccccgttaaaatcaggaagcccatttcaacaaaaggacctctaagcttttccccagcttacacggaacatctaccatagcacttttcaaaaatgctggttctcccatttaaaatgtaaaaggaatatcatctgggccctgttggggacatagttaggggtagatgagcaggttgcaagtgataaattaacaacagcctttttgttctaagttattggatgccttcctgtacattacacaaaggaatttctggcattttaactttgtttagttttggccacatttgagtccagattttagtcaagcagttgagcaaataatttagaaccatccccagctgcttgagttagcactgcgaatcaaaaatttctgatgaatatcttaattcagcccgatttaaattatgatcctttttctctctggtctagcatggttagaatctcttttaccatgtggtcccaaggttttcccctgtaaattaacaaaatcagccgttctttttgcatgttggtttatttttatgtctgaaggcagtgagggatggaagggtacagtcattatggtgtctttaagcaaagtagcgctagtcttatcagatatactctgctggtacaggaaacttagtagatttggagaacttctgttatttaaatcctcccaaatgtctccatttaaattcttggatcctgctctttcataatcagtgccctcttctgctcctggccaggatgaagtaactgttactagacttaccctctttctttaaacaatggttgcagttcctattgctgtgtaacaaacccactcaaaacttagtggcttaaaacaacagcaatcatttgtttccctctcatggtttctgtagaacaggaatttaggaagggtttgactgagcagtggtctggcattactcacgtagttgcaatcagatggtgctgggtctcggacacttggggactggctaggcaactctcttcatctaatctcagggcctgtcagtgggatttctccacatgaattagcttgggcttcttcacagcatgatgactacagggagtaggactacttacctggcagctcaggactccaagcgaggattgcaagagaaccacacagaggctgactggcctgttatgctccagctttgaaagtcgcatagtgtcacttttaccatagtcccaagcccacccagagcaatcgctaaagaatataaaatgatatataactgaaagccaatagagaaaataaatgggagactaaagcatactcggttaatccaatcaaatgcctttttttttttttttttttttttttggagacagagtctctctctgtcacccaggctggagtgcagtggcttgatcacaggtcactgcaacctctgcctcccactctgcctcccaggctcaagtgattctcctgcctcagcctcctgagtagctgggattacaggcatgtgccaccgcgcccatatttttatacctttagtagacatggggtttcactatggtggccaggcttgtctcaaactcctggcctcaagtgatccgcccacactggtctcccaaagtgttgggattacaggcttgagccaccgtgtggagcccaaatgccctaacattcacatagaactagtgaaactgggccgggcacagtggctcacacctgtaatcccagcactctgacactctgagaggccgaggtgggcagatcacttgtggtcaggagttcgagaccagcctggccaacatggtgaaactccctctctactaaaaaacacaaaaattagctgggcatggtggtacatgcctgtaatcccagctactcgggaggctgaggctggagaatcgcttgaacctgggaggtggaggttgcagtgagcagatcatgccactgcactccagcctgggcgacagaagcaagactccatctcaaaaataaaaataaaataaaaaataaaaataaataaaaaattaaagaactaataaaacaattcattctacattctttttttttttttttaattgatcattcttgggtgtttctcgcagagggggatttgccagggtcataggacaatagcggagggaaggtcagcagataaacaagtgaacaaaggtctctggttttcttaggcagaggacccttcggccttccgcagtgtttgtgtccctgggtacttgagattagggagtggcgatgactcttaacgagcatgctgccttcaagcttctgtttaacaaagcacatcttgcaccgcccttaatccatttaaccctgagtggacacagcacatgtttcagagagcacagggttgggggtaaggtcatagatcaacagtatcccaaggcagaagaatttttcttagtacagaacaaaatgaaaagtctcccatgtctacttctttccacacagacacagcaaccatccgatttctcaatcttttccccacctttcccccttttctattccacaaaaccgccattgtcatcatggcccattctcaatgagctgttgggtacacctcccagacggggtcgtggccgggcagaggggctcctcacttcccagtaggggcggccgggcagaggcgtctctcacctcccggacggggtggctggccgggcgggggctgacctcccccacctccctcccggacggggcggctggctgggcgggggggctgaccccccccacctccctcccggacggggcggctggccaggcgggggggctgaccccccccacctccctcccggacggggtggctgccgggcggggatgctcctcacttcccagacggggcggctgctgggtggaggggctcctcacttctcagacggggcggctgccgggcagaggggctcctcacttctcagatggggcggctgccgggtggagggtctccacacttctcagacggggcggccgggcagagacgctcctcacttcctagatgggatggcgggcgggcagagatgctcctcactttccagactgggcagccaggcagagacgctcctcacttcccagacggggtggcggccgggcagaggctgcaatctcggcactttgggaggccaaggcaggcggctgggaggtggaggttgtagcgagccaagatcacgccactgcactccagcctgggcaccattgagcactgagtgaatgagactccttctgcaatcccggcacctcgggaggccaaggctggcggatcactcgcggttaggagctggagaccagcccggccaacacagcgaaaccccgtctccaccaaaaaaatacgaaaaccagacaggcgtggcagcgcgtgcctgcaatcgcagacactcggcaggctgaggcaggagaatcaggcagggaggttgcagtgagccgagatggcagcagtacagtccagcttcggctcggcatcagagggagaccttggaaagagagggagagggagacggtggaaagagagggagagggagaccgtggggagacggagagggagagggagagggagccggagccattctacattctaattcagctatcctataggagcagtatctacctacctttgattttggcttttacctggttggtagctacagggaaaaataaattcttttagataatcatagaaattccctggttctctgacctgggggatttaaaacactgagtgttgtttgctttctttgagctgtctagtgaacttggaaacagccaacttacctcacagttgttgtattccctcataatctatcactcaatatgcaaagccgtgcattaggtaactgtcttagttctgttactacacatgataacttaagtaattctttcatcatgggatatcatggactaccagtgtttaaccctcttatgatcactgcagcctttctgtcttcaaacccaaccagatcagataccaatcacacatttccatttgccccaggagtacattgcctgaaatcatttctatacccaattactataatggtcattgtttaattacagaccactacagtacgctgtaactggctaaagcagaaaggaatttattaggtgaattggcctccagaatttctggggtgacgtgggtaccataccgtcagtatcgggctgtcaagagaaatgccttcaatcacgcagtgagatgatttcagcaaaaattctgctgcggctacagtttgtggttgaatacatctctttataggtgactagagttatagttaggtactttaatagctattgtattgatgtttgaagagaggaattacatggattatattctaaaactttatgtttattttgactgggacttaaaagtattttttcttagaaactgttttataaattccagtttcactttcagattaggtctaaaagcatacacaacctgaactatatcagaatgcagaggagccaacatccaaagacacttttagaagtatagtcttcttttaaaagagttcacaaaaattagactgcttaaggagtatagatatgcccaacctaaagaaaatcaaatatacagactttcggattgccaactgatgtatgttaggggctttaaagtctcattttagctgctaaaggatggctttcctggatatgtacatccattttggcaatggctatcctagcgtccttggcagcaccactgctgtttacgtgaaggcgtgtgtgtgaggatgcaaagtagagctactactgtgcttcttggtctatgttgaagtttatcagaaatgggatggtggacatggtggtgggaggaagttgaggagtggtggcaacaagtacacaattagcctgagtgatgaggtagctccaaactgtggacatatgagaataatgccgaagtctgtgcaatgtattgaggatgatttttaatttctaaagtgaatgggctgtctggaatcaggtaggtctagtatgagcaagttttatctgtgaagtaggatgtagtttgataaagaggtaggttttaagcagtgcctattaagttgtatgtaaatttagatacaatttaatagacattgctaaaaacccctcctttataaattccacagtgatcccaggctccccaaccataccgttttgaaaaaggaaaaacatgcttttcattgcctttgggtagaggtgaatgaaaggtactgctctaaaaaatggtcacagtggcgacacctggagcaggtagtgaggccacctgatatcattaagtaaacctctcttcggtgcctttccttgaggaccccagagggccagtgaagcagtgttccccttttattccttgttcctttcttttacttgcaccttagagacatacctctttttattacacttcactttatagcacctcacagatacggcgccttttacagatggaaggtttgtgacaaccctgtgtcaaacaagtccgtcagcaccatttttccaaccacatgtgcttacttcatatctctgtgttagcattttgtagcaattaagctgtgcacatttttttttagacaaaatgctattgcatacttaatagactacagtatagtgtaaaaacaacttttttttttgtttttttgagtcagagtttcactcttgttgtccaggctggagtgcaatgactcagtcttggctcactgcaacctccacctcctgggttcaagcgatttctcctgcctcagcctcccacccaagaagttgggattacaggcaggcacctgccaccacgcccggctaatttttgtatttttagtagagacagggtttcaccatattggccaggctggtcttgaactcctgacctcaggcaatccacccacctcagcttcccaaagtgctgggattccaggcgtgagccaccacgtctggcgaaaaacaacttttatgtgtgctggaaatcaaaaactttgtgacttgctttattgcagtattcactttattgcagtggtctgggaccaaacccgcaatatctctgaggtatgcctgtatttattttgtatcggtcctcttactcaacctgtgtccttgataggtcaaataagaaatctcaaacgttgaaaataaaaatttggattgtgtgagattaaagatgtatatgtgctaaaaaaaaaaatagcagttaatcactcttaagcaatttcattatttctgttgtttctaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcaggttagacaactcataaccccctgctgctctcagcgcttgtgctgttctttggatttgatcttacagaatgagtacccattttctaacctgataactggtgagtttgtttttgacagctaagaacttagtctctaatagactttttgcttgttgcaaacttgcttgttgcaaaaagtggataggttttttttaattcactttctattactttaactttctgtttcattttgttatttttttcccttatctgtccttaactgacatacaactattaaaattaggtccaattttgagcggatatgttaggaagaaaatgaacaagagccaaaattgcagacagcataggactttgcaagtatttgctgaaatcagtaatgaaagaaaaacctttatataaataggatagcatatagaatggattcttgatcattttaagaaaaacgtgtatttatatacacacaaatacatttaaatgtttaaaagtttttaaaggtttgaaaaaaataatgcgaaagggtctggatctttaaactaagtgacatgataaatccataggagtggacctaattttgagggaaaagagattaaccttattttgtacttaatgatattcagttatcagaatgttttattattagaaatggtcattttttctaccaaactttatttataactgccttcccatttcaccaatcaaaggcacatataactgtcaatcattgctgttgaaaaacatgcacactgatttgctgtaatcaccagttaaaatactaacttataattagtgactaatgttcaccaagcacttactatgagccaggtaattcattaagcattttgctagtattcgaatccagatggtctgattccagagcctacactgtctttttttctttaattgtggtaaaaaacatagaaaaattaccatcttaaccatttttaaaagtacagttcagtgccaggcatggtggcttacatctataatcccagcactttgggaggccaagggattaattgagctcaggagtttgaaaccagcctgggcaacatagtgagacctcatctctgaaaaaaataaataaataaaattaaatgaaagtacagttcaatagtgttaggtacattcccattgttgggcaaccaatctccagaactttttcatcctgtaaaaccaaaactctatactcattaaacaactccctgtttccccttcgttccccatcctggcacctgcaaccaccatttactttctgtcttatgattttaactgggtaactgtcttatgatttttactaggtaacttgtaaaagtggaatcatacaatatttgtccttttgtgactgacttatttcacttagcataatgtcctgaaggttccttcatgttgtagcatgtgtcagaacctcctgcctttttaaggctgaataatattccattttatgtacatacttccttttgtttacccattcatctgttgatggatacttggcttacttccacctcttgactattgtgagtagtgctgctgtgaacatgggtgtgcagaaattgtcatttttgaactggataactgagggaatgcgttttacattgaaaaaaaatcagaagtgcattttcttatgctggattgagctaattgcttactttccgaactctgaatggtgaatataattagaactttccaaatcaggtaaaaagcctggagaagagagtaggacaggtgtaagtacagaatatcagcagaaactaatgggtgtatttgacagcaaggatgcttagagtatactaaggaattggtttttgttgacagtttgctctaagtcactggggatgattttgtcccccagaggacgtttggcaactcacgtagtcatttttggttttgacagtggggacgtgtggggatgtgctactgacatcgagtgggtggaggccagggatgctgctaaacatcccgtaatacacagcacagcccccacaataaagattatctggcctgtcatgccactagtgccatggttgagaaaccctcctctaacttgattatcactctattttttttggcggcggggaggggttggtttttggtttttgatagaagggagaactcactcaatattgtttttaaaattttacttttctgaaaaactgtatcatatccttgcatatcttggaagcttctgcctaaagtttaccctagctgcagttgccttatgagtgggggaagtgagttccctcgcttagcctgccacaatcgcagttaaatcagtgccaggtgcctcacagacatgaattgttctctgcagcgcacagtctgttctcaacacatcagcattatccttttccttctgcctcgctggcagctccttctcaggctcccttgctggttcctaggggtgccttaaaggcttagtccttggaccttgtctttgtctgcacttacttccttgatttcatctagtgctggagctttaagttccaactatacactgacaacttcccagattttattttcactcctgttttctcccctgaactcgacgccagtacttaactgcttacgcgatctccccattcctcactccaacctaacatttacagtatctgaagtgttctccccatccctaatccctcttcctcccaagcttatccttatcctcatccctataaatagcaaccccatccaaccttggagtcatgcttaattcctcttacccgtataccccacatctaatcgatcagcaagtcctagcagatctgccttcaaaatatgtccagaatcagactgcttcttaccacctcctgtcatcctggtccaaatccccattgtcttgcacctgattaattatgttacctccttattggtcttcctgcctttctccttgcccctctgcctattctcaaaggacatccacatttatctttcaaactcaggtcagttatggtaatacccagtctcttaatggctctcaagactttccccagtatctagctcccggcacttcttcctccttcctccaattctccccttttctcaccccacattgccctccttgttctctgaatatgccaggcacattcctgcctcagggtcttcctcttgctctttctctgcctggaatgtccttcttccagatatttcattcaagtctgctcgaaggtcactttctcagaggggccttccatgatcattctatttaaaatcatacccctaccttatactcctaattttccttccctgctttatttttttccgtagcacttatgtatagcttacttttttaaaaaagttctgttttgtcttcactagaatgtaaggcctattaaagtgccttgtacttatcagatattcaataaatatttgtcaaatgggtgaataaatagtatcttcaactactttttttcagtcaaatatatactaattgtctgccctgcacgtagcactgagccaaagaatgaagacatagcagcaggtcagcagatagtcccatttgcaccatggcaatctagtgaagcaaacacagacagaactagctaacaatatgatgcaacaaagaaaaacctagcaatttatatgtaaagcaccagttatatagaggccaaagagaacatttctacttttggtagacaatgaagagaggatgttggagtcggctttgaaagacaggtaggactagaataggcaaaggaagtgcagtggtgggggcattctaggcaggtgaagagtatgagcaaagctctagaaacacagagagaagtgtgtgtgtgtgtgtgtgtgtgtgtgtgtgtgtgtgtgtgtgtgtgtgtgttgggggaacagaggtttggtgaagaggttagttttttagggtagaaggaagtagggcagttatagtgcgaaacctagactggagccaggctgtgaaacgtcttcaatgtgaggctaaaccgttgggtttttatttgacagatagccattaaagggttgatttctttggagctttgttttaaatgaaggaatgtggtgtgtaaagaggtaattcaggaatattgttttggtaacactggctgtaggagattctagatggaggctgagttaagagactgtagcaatagtttagttttttgggtttttttttttgttttgttttttgagatggagtctcgctctgtcacccaggctggagtgcagtggcgcgatctcagcttctcagctcactgcaatctctgcttcccaggttcaggcgattctcctgcctcagccttccaagtagctgggattacaggcacatgccaccatgcccagctaatttttgtatttttagtagaaacggggtttcgccatgttggtcaggctggtcttgaactcctgaccttgtgatccgcccgcctcggtctcccaaagtgctgggattacaggcgtgagccaccgcgctcagcccaatagcctagtttttagccatggcaattctcagtgtgggaggggcaataggaaggaagggatgaagtgagggaagtcacaggggagaacttgacagggcttgctggtctcattatataatttagaattaattatttacgtagacaaagaaatgacaattgctcaaagcagagtcacagtataaacagatgttatgtgaaaatattttggagcttctcatatggatccaattcaggcgggcggtaaaccatgccaaaatatgcaggtattgaatgctgtaattgtacagaactactacaagatgcaaacttgaacactgtagactcattttaactgtgaaccaagtttgaactgtctggagggagaacgcctatatgctatgttgtctcctttaagacctgcaataaagggaaaatagaaacatggaatttaaaaaaattctatcctcttttttagacatatccaaagaattaggttaaataacaaaatttaggcaaaccaaagtggtatttgaatggcttctgcacctcttaataactttctaaagtcaaattggtataagagcagttgtatctggaaagggttagggggaaaaaggctattgtccatcttttagatttaagcgcattttaaagtgagagcttaaataaaaacaaagaacttctataaattgagtgagagctcaagtttaaaaaatgagagctcctatacgaaatagaggggtttggtctaataacagggatgagatgcaaaactaaatacattgtctatggtgcattcattagagaaccaaaagacgtaccacttatatttacgctttggagattgctagctattgttcacttatacccacttgtttcatttttgcaagtgacttctgaaactacttaaattcaaccttagatttctgaggtttgcgggatagtgaaagctgaagaaaatgggagggaaatctgaccaaatctcccaggcacaatttcccaggcagaggctagaattaaaatatacattcttattcctattcttaggtagttattattcctgttaacactctacttttatgcaaaaatgtaaaaaccaaagaaattactcagctatcaagccagtacgtttagcactgaaaaagagaaatattatgtcctgtcagtttttccatctcccacttaacacacatacagttttcctttacttttgtcagtctcttctacctttttaaaaatttattttccttaacctcctcctcagtcaaccagtcactcacctttgtgagattatatgatactgtgaacagtatatgtacaagcataccacagagatactgtagattcagttccaggccaccgcagtaaagcaaatattgtaataaagcaagtcatgcgaattttttggtttcccaggcacataaaggttgagtttatgctgtagtctatcaagtgtgcaatactattatgtctaaaaaaaaacaaacaaaaatcataaataccttaatttaaacctactttattaccaaaaaaaaatgctaatgattatctgagccttcagtgagttatcatctttttgctggtggaaggtcttgtctcagtgttaatggttgctgactgatcagtgtgatggttactaaaggctggagtagctgtggcaattccttaaaataaggcaacagtgaagtttgctgcatagatggactcttcctttcatgccagatttctctgtagcatacaatggtgtttgatagctctttagccacagcagaacttctttcaaaattggagtcagtcttctctaaccctgctgctactttatcaatcaagtttatgtaatattctaaatccttgtcatttcaacaatgtttacaacatcttcacgaggaacaaattccatctcaagaaaccactttctttattcatgcataagaggcaacttctcatttcttcaagttttatcatgagattatggcaattcaaccacatcttcaggctcccttctaattatagttctgtatttctgccacacgtgtagtgactgcctccactgaaatctcgaacgcttaaaagtcatccatgaaagttggaatcagcttcttccaaactcctattaatgttgatgttttgacttcctcccatgaatcaggaatgttcttattggtgaacattagaatggtgaatcctttccagaagattttcaatttgctttgcccagatccatcagaggaatcactatgtatggtggctatatacccttgtgaaatgtatttctcaaataataaaacttgaaagtctagattactccttgttccatggctgcggagtggttgttgtgttagcaagcatgaaaacattaatctccttgtacatcttcatcagagctcttgtgtgacgaggtgctatgtcaatgatcagtaatattttgaaaggaatctttttttttttttttttaaggagtaagtctccacaatggccttgaaatattcagtaaaccgtgctgtaaacagaagtattgtcttctgggcttcattgttccacttacagtcctcaggcagagtaggtttagcctaattctttagggctgtgggattttcgggtggtgaatgagcattggcttcagcctaaagtcaccaggtgtattagcccctaataggagagtcagcctgtcctttgaagtcaggcattgacttctctctagctatgaaagtcctagatgacatcttcttctaaaagaaggttgttttgtcttcctagaaaatctgtttagtgcagccaccttcatcaatggtcttagtcagatcttctggataacttgctgcagtttctccatcactacttgctgtttcattgtgcacttttatgttatggggatggcttctttccttaaacctcatgaaccatctctactagattcaaactttcttctgcagcttctccacctttctcagccttcacagaattgaagagagttagggcctagctctgaattaggctttgactgaagagaatgttatggctggtttgatctatctagaccactcagactttccccgtatcagcaataaggccatttcgctttcttatcacttgtgtattccctggaggagcacttttaatttccttcaagagcttttcctttgcattcataacttggttaacagtttggtacaggaggcccagctttcggcctgtctcagttttcgacatgcctttctcactaaacttaatcatttctagctttcttttcatttgatacattgtaattatacatatttatggagtacaattttctgtttcaatacaggtatatgttgtattatgatcaaatcagggtatttagcatgatgatcacctgatacatttatcatttctttttggtaaggacattcagaggcctcgcttctagttcttctgtgatccacagtccctcatcatttctagcttttgatttaaagtagggtatgtgtgactcttccttttacttgaacgctgagaggcactgtagggttattaattgtctaatttcaatattgttgtgtcttagggaagcgggaggcctgaggagagggagaagataggagagtagctggtcagtggagcagtcagaacatacacagcatttatcagttaagttcactgtcctatatgtgtgcagtttgtggtgcccccaaacaattgcaatagtagcatcaaagattactgtttgcagatcaccataacaaatgtaataataatgaaaagatttgaaatattgtgagagttaccaaaatgtgacagagacacgaagtaagcacacagtgttggaaaaatggctgatcttgtgttatttgtatttccctacttcacctcatattgctttattatttatttatttatttttgcaacagggtctcactctgtcactcaggctggagtgcagtggtgcgatctctgctcactggaaccttcatctcccgggttcaagcaatcctgctgcgtcagccacctgagaagctgggactataggcatgcaccaccacgaccggctaatttttgtattttttgtagagacaaagtttcattatgttactcaggcttgttttgaactcctggcctcaagcgatctgccccgcttgaccttccaaagtgttgggattataggcgtcagccaccatgcctggcttcatactattttaaagcaaatcccatacatcaaatcatttccttaaaaacattttgagtatatttgtctaagaaatagggaattttttaaaaccgtaataccattgcacttaaaacatcagtaataatttgtaagaaacttttgattgagtttctgattttaattgaataaatttatatcctttactagagcagactgtaatagaggcctgtaatttagcagcatctaaatctggtgaaacattacaaaaatcataaatagagacagcatatttgatatattttgtcttgttaaaaatatttgttgaagaaaagtaccctaaatggaagccaaaagatactaagtgaatatttataagtttttttttgtttttttttttttttttgagacagagtctcgctctgtctcccaggccaaggactgcggactgcagtggcgcaatctcggctcactgcaagctccgcttcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccattataagttttaatattaacaaagctagaattaaaaatatgttctatttagcagaagttgctctgagcttaccaggtacatcagtatacttcaaaataatattttcaattaaaattattgtgtcccctagaaaagagtcaataaaagagtcaacaattttaaatgtgtaaacaatgaatctgacaattaacaataaagaacaactttgaagtagcaggtaatcttaggaaaaaataaaaaatactaagatcatattgaaagaatatattcattagtaaaatatcaatgacatggtattagcataaaatatgactaaaacactgattaaagcatatgaatgtctactcagaataattaattttaattctgtaatagattatggaaatgtacaaaattataattgtacagcttgattaattctcctttattattttttaatgttcacataatcagcattaaaatttttttactttaatgtagttttatttttcaataattttgtttttgaaaataatttttgaatagaatcatcttataagtccccagatggagtaaaaccaatttattgatcaacagtttgttggttgataaatatgtttatttaaaccgtgtaatttaaattattttctttagtgctctggttcactttcaaaagtgttgcagtttgtacattacattatgtggttgcctaactaagcattatcaagtacttgtatatcagatatggatgtggttatgaattgtgctatgtcaacctatcaacagagaacagagagtttctgccaggaaatgataatggacagaactagtttccaaagggccttaaatgccctgtatcaagattacctaaccctgtagatgtgggagcctattgtggttttgaattaaaaagtgatatgacaaaagtggtattatgggaagtttaaataaggaatgaatatcatgggtgagttatcagtggcttgagtggtaagcatggaaaacatagaatgactgaagcctcattacagaggaaattttctgggacttacacattgggctggcagtattgagggagacgttggaatcagagaggaggccagttttctcaattttctgattaaaaaggaaaatgtctctattgatagccatagggatttaggaggaagggaaaatatcttttgccagcaaggtgatgtggttttggatgttgaatatgaggagatggtgctgtattgtagcagagattgttgctagtccattggagataaaagccctagtgaagcccaacagtgaggcctgagcatgcagatggggcttttctgtggaagttacttgaaaccatgaaagtgagttcttcacagaaaactgtgttggaagagaataacaggcaatgtcctgagctttgggcatctcctgaagttggaagaagataggataaatggcaccagtgaaacaggactcaaagtacatcagagtcttggtcagagggatagaaggaaaccccagcaaggggttcatggcacctaaaacaagagcaaatgtcagcgagttatgtcacatgtagtgataaagtgcagagggctatgaagaggtcattggatttggagctcactgatgacattcaaaaacagattcaggagagtaaagggtgagtgatagatgaagaaatggagatagaatctatagactgttccttttaggagcacgtcagagagatgagagacaaatgtagagtgttgtactcagaggggcagaaaagtcaggtaaaacatttcaagatactggagacctttacatggaggaaggcagaaatgaaagactcctgtggataaaggagagattgaatattgtaaggagagaggggagataaatagggaatatcattctaggggagagtggaatgaggagaagagatgaagatattagctttggaaataaggaatagtattaaaaatgagactggaaaatgagaacattaacattataatagctatttctattcattaagcatctatattctaagctcttatgtaagtatgaactctttgtaaaccattgaggtattgagggggatacaggagaattgtgttaagacacagactcctgccctccaggggtttatataggttaaatggagagaggaggcatgaatagcattgtgtgtagccaaggaattgagtgaataggcaacatgctttgggtgcctggcaatgcttttgggtggccttgtaaataaggatgtgaatggtcagaaaaagcctgatggaagtgaatattggtgtgaactaccaggaatggttgggatttggataggtggaaaaaattgggaaaatatgtttcaaggaaggagactagcggatgtaaaaaccaaccctgcagagagcagtttcttggtaactatcagttttggtggtttatattttattcagttataataatgagaatagcaactaatgctgagtatttactcagtgccaggtactgttctagaagcattttccatatatttttaattctctgcagtcactgagttacttattgtttttaccctactttcataaatgaagaaatagagggttaagtaatttgtactagattttacagtttatgagggatggggctgggatttcaacctgagctttctgattccagagctcttgctcttaacctcttcacagttttgccctcgaggatatcatagtatgctaggacgtaatggcagatttggttgaggtcaagttataaaaagccctgaataccagtctgtcaggtttgaacttttttcatcctttaatgaagagccatcggggctttcatcagaagcaaagtgagaatgtaagattgatgtttgggaaccatccagcacatgttagggagtgactctctttgagaccagggatttaactgagccgacctttccaaggccattgctatacataagaccagacttctatgatacagtactctgacattttaatcatcttagcggtttgtacatgctgctcttccttgatttaactttttctttcattttagcttttgaaaggataaaatatttttatttgaaatggatttatatcgtttctgttttgaacttatgttatttgtggtgggaagacttgaggatgttggaactcacattccaatagggaggataggatgaacatatgtgaataatatgtacggaaaaaagacattctttcctttttatttttcccttctaatattggtaagcagtacagaatgaaagtcttaaggtgtaacttgcataactgccaagaaatgtgagtactgtgataacatctgggctgtaggtgtgactgatgcatagtggggaggccgaaagctttgctaccatagacctgattctgaattctggtaatcccgaggaagataacaaaggcaaatctcttcatctttctgagcttttaaataatggagtttataatctctacctggatttgctgctgagaaaattagagccagtatatgttaggtgtctaacatatttcctggcccatagtaagttcgcaataatagatgttacgtagtcgttcttttcttttctgcctgttgcactgtagaaaaaccattgttgccccattatctgtagcctaaaattagggagatatatctaacaggagaatctcacatgcagatgacatataaacacctgtgttactttgcattgtgaattatttgaaaagactcagcaaatataaagaccagtggtaaccaaatctagcacaagaattaagagaagggcattcagtaattaataacctctagtaaaagaaaaagtatgtataaaatttagttgatcctttagtttaagggaagacactgaaatagaagaaattattcctttggagagatcaggaagctggtaggttaagatttatatttcctcatggaaggagaacttagaatttagtaaatgagaaacttggctatgaaggagttggcagtgcacatgaggaaaaaaatgagcatcaagcatcactttaggaaaagctactatcagacaccattgatgtcactcttggatttcacttcggtcatttcctgtttaatgataccacattcaacaactcatctgtgtttggggtcacagaaatcaggcaggggtacagaaagagtggagagtgtggtatggctttaggattagattattctacattaacctttattatatgtgacagaaaaattcaaaacagttgatcatatgagggaaattagccaaaagtttgaatactgattatcaatgatgtggaaactttcaagaggaagggagtttgagtagtaggttcataagtggtacccattgcagatgtgtcttaaatacccttgtaaaaattaactttttaattataaaagttatctatgccagttgtctagtggtgcttagtttttgctagccctcagggtagcaaactttaatttttattttaattattaaggtttaataagtattacagtcactgtcttcagcacacatatttcacacttgggttgaggaaccattgtgtggctttaagccagttatttcctttgtaagcatcattttcctctagatctcttttgaactgatttctaaggtctctaattgaattgattcccttccagttcttcaaacctgctaattctaaataccggacgatccctgacttacaatagttccacttaataactttttgactttatgatggtgcaaaaatgatacattttcagtagaaactatgcttagagtaaccatacatctattctgttgataactttcagtatagtagtcaataaattccatgagacactccacactttttaaaaaataaaatcggctttgtgctacatgattttctctatctgtagtctaatgtaagtgttctgagcatgtttaaggtatgctaggtgaagctattaggttcagcagatcaagtgaatttaatgtatttttgacttaacaatattttcaatttatgatggatttatcagaacataaccctataagttgaagtgcttctatattccattctattgtcaatgtccttattttgccactagatggcaattgtgtaccttcgaacccagtcccctctgggttttcagaatctggggcatctggagaactcaggaattttagcctagtccacccctgcttatttcacacttggggaactgagactcataggttaagtgacatagccagggtcgtaacagttactcagagccacttgaatcccagtcgtctttctcctctatcacactctaggggactttgtgagggaaattcaaagaaaccatgctctcaaccttttgagttctttgtgaattatttttaaaataatttaaagccattggttaagtacaggtattatcacattcaaaataaacagttggcctgcttttgtgtttctctattggctccctgagacagaaacgctagacagtcagctttgaaaggttattggctgcatacagccagcttgccttcacgatttgccctggaaataagctctgcagaaatctcaaccagggcctctctatcaggtgattatctccctccattcttgccccatcctgtggccacccatttttctatgttttcttttgtccacctgactagcccaatcaagagagcgtttgtgggggaagagatatgctcctggttcttaaagaattatcttttgggttttcccagcacatgttaactgccctgtttccccctctctctttattggtgacaaggatggtattgccataaatcatggcttgtgtataggcagaatggtgttgtcggaggcagagaggacgtggtctttggagtcacactgactgtgtcgaacctctcctctgtctgtgactgactctgactctttgtcgcctctcttaggagagtgagattgaccaccttgcagggtgggtgtgaggaacgcatgagtaatgtgtggaaagctcatggtgtcagtgcttggcacacatagcagatgctcattaagagctaattattttggttgttattgtaaagagaggaacaggagtaactataatatatgaaagaagctcaagggaggatctcagccaaaggagctagttttttattggagaaagaagggaaggatgcaaggtattccagggcctatgtcagtgttttagagaaatagtgtaactgtgttaataatggtagccactagccatgtgtgacaatggacacttgaaatgtgactagttgaaattgatccatgctgtgttgaattcacatcaaatttcacaaatttgtgttgaattcacatctttgaattcacatcaaagacttggtgtgaaaaagtggatataaaatgtctcaataactttgtatagtaataatatattgaaggaatcgcatattggatatgtagagttaaataaaatgttattaaaataaatttcacccttccttttacttttttttttttttttgagacagagtctcattttttagcccaggccagagtgcagtggcgtgattgtggctcactgcaacctccacctcccggttcaagtgattctcccacctcagtctcccgagtagctgggattacagacgcatgcctgctcatttcttttgtatctttagtagagacagggttttaccattttggccaggctggtcttgaactcctgacctcaagtgatctgcccacctcagcctcccaaagtgcagggattacaggcatggaccaccttcctttgactttttgaaatgtagaaaatataatgaggctactagcatgatacttttatgtgatagcactggacgagaagatagagatttttgtacccaaacatatacaactatgttctgaggaatcgagagaggttttttttgaagcttcttttgattttgtttttcttttatgatgttctgttcttaagagtatgactattctgaactgagatgccagtcactattggtaatagcagtttaagtaatagtttaaaaagaaaaaagtaaaagaggcaccaaatattgtctgtagtcccccaaattctgaagacctcaaaaaagaaaagccattggatgatttcaaagaacaccactgtgtgcaaagctcatttcccttcttgttgtcagtagataaaacctagcagttaacgatcctaggatttttccttccaatgcaaagtattaaaacactgcaaaaataaccaagagtaaaaggaaaagagaaccataatacttaatgttaaattaagtcatctgtctgattttcattaaatttgttttggttttaaagacattggttacaaaccattcagtagttttaaaaattaaaaataaaagataacctcatcaccagtctgttttagagctagaaggtaattgctaattttggacatttgcaacccttgtaaatcttcttagatggatttaaaaatgaagtttttatttagattttgaatttacatgtgtttttgtttgtttgtttgtttttgagacggagtctcgctctgtcacccgggctggagtgcagtggcgccatctcagctcactgcaagctccacctcctgggttcacgccattctcctgcctcagcctcccgagtacctgggactacaggcgcccaccaccacgcccggctaatttttttgtatttttagtagagatggggtttcaccgtgttagccaggatggtctcgatctcctgacctcgtgatccacctgcctcggcctcccaaagtgctgggattacaggtgtgagccactttgcccggccacacatgtggttcttataacaacacatgggaaatagtatctgttctttgctgatgcagaaaacaagcagagcacatgcattttgaggaccttgaggtcagttctcattgttcttgatttagtctcaaaataagaatcccttattccaagtaaacttggtatcataattctttgtatctaagatgccatcggttgtaagaagtacctttaagtaccactttgtatagaaaaaaaaatgttgccaataaaactgataagctattggtttttcagatgcatctctatttcagaaatgttaaatggtggggaaaaaagtacactttaacattgatgaaatataatacacagattttgaaactttttacttggttggagtttagagagcttgttttacatgttagcatcagactttaggttctctcagaatgtatcatgttcagcaagtgtggtttggtgcattgaagctcttttcatttaattttattaaaaaacagatgaaagcaaagtggtgagctcatttttaggttgttgaaagttccatgattcaaaaaagtgaacttctaacttttagtttcaacctagtacctctgcttctgccccctcccagtagacatatatccatcctcttttcagtcattacctgtccctctaacaaaatctgttctccataaaggctcctgataacagttatttatagcctcctgtgaattcatggcaaagcgttaaatggcccaagtctgcttgctttctaagctttatctctaattactggctaaaaatctttatctgcttaaagaactttcaggcctctgctagccacatggaacaagttttgtgggaatggctgaaggaggagtgatgtagaggcagcctcctactctgcctctatggaaggctgtggatagagaacagagtacctcattttctttcctaacctaaactgtccaagtaaatctgacagctggctcagtgcctttctggaagtcagtaagaaaggagacttcgatctgcttataaagttgcctttgctgactgttggaaggaaaacaactcataatagctgcatttctgactaattccattgaatttttgttagttttttgtgtttttgtttttgttttgttttgtttgagatggagtctcactgtgttgcccaggctggagtgcagtggtgcaatctcaggtcactgcagcctccacctcctaggttcaagcgattctcctgcctcagcttcccgagtagctgggattacaggtgcacaccgtcatgtccggctaatttttgtatttttagttgagacgggggcttcaccatgttggtcaggctggttttgaactcctgacctcaagtgatccgcccacctcggcctcccaaagtgccgggattacaggtgtgagccaccacacccagccgaatttttgttagttttatctcccttttgacagaggctattgaattttaaggaaatattatgatgtacagatttttttttgtaatctgaatagctacttcctattttatctgttttctaaatctcagtgtttacacatctaattggcttaggtcatactttacattttgagtaactatttggtaatccagattctgaacctcctttttctaaattaatttcaggcatgcctaaagcagatatatgctagggcagtttggctcttggttaagctgcagaagttcttgtggtctagtttgaagatgaaaacagaaatttctttttttgagtttgtaatacattcatcagttgtgaatctgctgatactttgtatatggtggtccctcagaatgcatgggggattgcttccaggcgtcaccgcccccaaccccaataccaaaatccatgatgctcaagtccattgtataaaatgctgtagtattttcttatgacttatgtacatcctcctatatactttcaatcatctcttgattacttgtggtacctaacacagtgcaaatgctatataatttgtattgtttagggaataatgacaagaaaaaaatgtttgtacatgttcagtagagatgcaaccatccagtttttttttctccaatattttcactctgcagctgattgaacccacagccaacatgcccagtaaggagtttggtttacactaagtatggactttttccgtgaaacatatgcaataatattgcactttttcagtgtttacattgaaaattatatggaaaaatttacctccattgctaaatattctacatttaaactaaatgtaaggcaaatatttattatatagctctgcattctttctaggagtgtgtttgttgatagcatcttaataattttcagattacattctgtaaatgtttctgtgtgtttgaatgactttgacttttggtctttgcagctcggggtgtggttttctctcggttgtgcctatttggccttggaagactatcaaggttcagcaaaggcatttcagcgctgtgtgactctagaacccgatgtaagtttgtttgatcttctgtccttacgtggctctttactctctaagttgttgaaattgtactgtatggttcagaacagcaattccttttgtgttggaggaaagtgtacatttgagggaaggtcgtacctcaaggtataggatttataaatctggaaataagttaatatttcatggtttcatttaggaaataattttgataaaacaattttcttgttaaaaatatacttcactgaatgtatagcaaagtatcatatatattttgtcattcattagtatgtcctgcctatgttaattgcattactagaaagttattttagggtggagtctttttatatttgatagttttatgagataataattcacataccatataattcacctatttaatatatacaattcaatgatttttagtatagttagaattgtgcaaccgtccactacaattagctttagatcatctttattaccctaaagagaaacccctgtacccattagttgtcactccctatttctctccaaacatcctccccttcagccctaggcaaacactaatgtgcattttgtctctatagattcacctattatgaacatttcatataaatggattcatactttttgtgggctcttgtgactggcttctttcttaatgttttcaagattcatgcatggttatagcatgcttcagtactttgttcctttttatgaccaaataatattccattgtgtgggtatatcacatgttatttatccattcatgagttggtagacatttggattgtttccactttttggctattataaatatcactactataaacatttgtttataagcttgagaccaacatatgtttccatttctcttggttatatacccagtagtagagttgctggatcgtatggtagctctatattcagaattttgaggatctgccagactgttttccaaagtaccattttaggccgggtgtggtggctcacgcctgtaatcccaacactttgggaggccaaggccggtggatcacttgtggccaggagttcaagaccagcctggccaacatggtaaaaccccatgtctcctaaaaatataaaaattagctgggcgtgatgacgcatgccgtggtcccagctactcaggaggctgaggcgggagaatcacttgaacctgggaggcggaggtcgcagtgagcagagattgcgccaccttactccagcctgggtgacagagcaagattctgtctcaaaaaaaaaacaaacaaataaaaaacaaagtaccattagtcccactagcaatgtatgagggttccagtttctcaacatccttgacaacacttgttactagctgtcttttttattatatctgttctagtgggtggcatctcattgtggttcaatttgcatgttttggatggctaatgatgttgagcatcttttcacatgcttcttggccattcgtatatcctctttggaaatgtctattcacatccttacccatttttaaaattgggtcatgtatccttttatcattgagttgtaagagttctttctatattctagctacaagtcccttgtcagacaaatgatttgcaaatattttctcccattctgttaagttttttttttttctctctattgattgtgcactttaaagcacaaaagcctaatcttgatgaggtccaacttacctgttttttcttttgttgctcatacttttggtacaatatctaagaatccattgccaaatccaaagtcacaaagatgtactcctatcttttctgctaggagttttatagttttaactctttcattaaggtctagggaccattttaagttaattttatttatgatataaggaaggggtccaacttcattcttttacatgtagatatccagttgtctcaaaactttgttgaaaagactattcttttcctattaatagtcttgtcactctggtcaaaaatcagtttactgtaaatgtaagtggtcaaaaattaattgactgtaatgtaaggatgtatttatggtccatcaatcacatttcattgactgtatgtcacatttcattgactataggtctgtgcatattccactgtcttgtttacagaaactttgtagtaagttttgaaaatgctgtgagtactccaactttgttcttcctttacaagatagttttggctattcagcattccttgaattttcctatgggatttttagctttgtaaatttccccaaaagaccttatattgaatctgcaggtgaataaggggagtactgccatcttaataatattaagtcttttgatccatgaacatggaatgtctttacatttttctaggtttctttcatttcttttaatatcttatagttttcagagtgtaagttttacacctcttttgttaagttattccaaagtgttttatcctttttcatactattataaatggaattattttcttaattttattttttatttttttgagacagaatcttgctctgttgctcaggctgaggtgcagtggtgcaatctcggcctacggcaacctccgcctcccaggttcaagcaattcttctgcctcagcctcccgattagctgggattacaggtgtgcagcaccacgcctgacaaatttttgtatttttagtagagatgaggtttctccatgttggccagactagtctcaaactcctgacctcaggtgatctacctgcctcagcctcccaaagtgatgggattacagatgtgagccactgtgccaggtctaaattttatttttggattgtctattgttagcatatagaaacacagttgatttttatatattaattatatcttgcaaccttgctgagctcatttattacttctagtaggtgttttttttttttttgtggactccttaaaatgttctatataaaagatctaaatttaatgttttatttgagaagaaagaattgcaatttggggcgtatatgcatgccaggtagtctttgaatgtctgaagaacaaggagaaggttagaagttttattaaaaggagaaatgttacatattgctctttgagaaattcattggcacttacagtaagggtttggggagctggcaagcttccattgatgagggatggcagagtgcaaaattagtcccagagtttcagcaaattatctcagaagctgcagataaaactggtttcaggttacgacaagcagttccagcagtcaggctgctttcatttggatattttaacagctttaatgtctctactaacattcccccaaacattctctcattatgttcatgttttcctttaaatctttgaacatgtttataataactgctttgaaatcctgtgcttatttcaacgtctctttcatttctggtactgtttcttattaactgatattttttccctttggttatgaaggaaattttcctgcttcttcccatgtccgccattttttaaaaaaattgtattctacacctcgtggatgctgtgctgttgtgcttcttggttttattctgttcttttaaggaagattgagttttattctggcattcagttaaattattcctaaatcagcttgtttttaagcttgttaaagtgggtctggagttgtccttattttctcataactctttaaaaaaaaaaatcaatggagatggagccttgctctcttgaccaggctagtctcaaactcctggcctcaagtgatcctcccatcttggcctcctaaagtgctgggattacagatgtgaaccactgcacccagccctctaataaccttttcttaaggtataacctctctgggattgaatttaatgccatgggcaatcaataagaactctccagttttgctagtttagaatttgaataacttctagcacagtgtgacctccaaaatctccattcagctcacagctttctggtagttattctttgccagacttcaaaaagttactaattttgccaagtctggaagtggaagtccactgccacttaatttttgagtcatatgtgtgggacttgagaatgatatatactatattagatgaaaagtggaacaaagagaaatagataatttatatcattcttgtttgaatcaacatttgtataaatttaacctgattaagctgatttaaaaaaacattcatttttgctttatttttgtcattgggtagaggaataggtagagaaatatctttgatggatgaaatacttagtagtaacactggagaacagattttttcttaacccccctatccggtgaagaaggatgacagtataatggcaaaaatttttaagataggaaaaaacagtatactgcattgccttttttgtaataaatctatgtactatatagagtatgttgtattagttattttgtaagtctaaatttgaaaataaaatcttaactgaattgctaattggtacaataatagttacattgcatagttgattgttttaacctttttctaaattataaaagttcagtttgatttaattttgccatatacctttaaacacactcttattgaaaattgtggttttaaagagcatatattggactaggagagtgtgttgtacttttggtttaagcaataattttacctaaatgagaagagttaattaactgtgttctctatcatttcagaatgctgaagcttggaacaatttgtcaacttcctatatccgattaaaacaaaagtaagtacatcagacaaatatgaagaaatttgcttcccaaataaatgaatgagattttctacaactgaacattgtttcaatgtttctccttgttttacctttctcgcccatgtatatgaaatagaataacttaagtagaaaaacttaattcaaactaaattaacttgaattctaaatatacagtttatttcttaaaaacatttcatatgtaataaaataagaaatgttacttgaaatctttatttattactgaagttttacattctacattttattacatgataaaagcaaacatatgtttagttggtcaactcagttgacagttatttttattcattgcttgctttgtactagacattattgagaaatataaataaatatgaaccaatgtcttcagggaatgtaggtttaaaaaataaaatactacgccatcttatttaaaaaattgattagtatataagctatctgtggcaaataccaaatgagaatataaagagggctaaaataatcatacatgatacttgtagcacacttattatgtgccagccactcatttagtcttgtgaggatcaaagaagagagaaatcatgtcatcctggatcagaaatgcttctgagagaatgttggactcaagcagaaatttgaaggatggatagaagggacagaggggagcctcttaggcaagagaaatgatgtgaccaaatgcagaatgacaggaatgaatgtagtattttaggagataagaagcaaaatagtccagctatgatgtgaaatatacggtgagagataaggttagaaaggtaggttgaagtaaaattgctgcatcttctgattatttgaccaatgattgagactgtcctgttgagaataggaagccagagatttcagtgtggtaatctcatgaagaaagaagcttttggggaagatttatctggtggcagtatatgaggcagactagaggaaactgcaggctgggaaaccagttaggacacagctgttgtaacaattcaggcatgagataactagagtggaaaaagaaggggcagatgccaaactctttataaaggagaaaaccaactaaacgggcttattgactggctatgaaaagcgaaggaaagggaggagacaaggactgctgttgccagaactctaataaattaaaggatggatatattttcatttttatttggccttactttcaaacttaatttaatttttcttggtggaatcacaagataatttctgaagacatcattaaatccatattacgtagagatcatgaaatgctgcctctgctcttggatgacataaataaagtctatctgttctaccattctctttagaagatcatattatgttcttgattgcaactgatagtgctaaaactctctggagacctttttggtttaaagcaacaggctcggaagtccctgtcatagttgtagaatgatctcagtgagtttttctggcaacccggataagtttgtacatagtgaagctcttgataccttgtcttccagcccaatcatgttaggaattctgctttctctcttaggggttcttgcatattgtttctcgactttcttacctcttgcagctccacaaataggttttcatgcaaaggtggagttgtaaggtctgagataaatcatttctttattctttcctgtttactcttttctttctttgctaaggttctagacaaagctaatgggattgttacttctgaggcaattattaatgcttctctcagaagatcctattcatgccttaaaacggcccattaaactttcttttatccttttgtggtcacaagattcttcactaaagtgctctctttgctgtttcaactgattcccctcgatatcatgttcctatcagtcccatgtaaaaatgtctatattcggatgtaattttaatggtgcaatatctctactatagaggggttttgataagtgaatcctgaagtgaagcaccttacaaagaagctgtatttaccaaaaaggaaaaaaggattcatggaacaattttgaggctaggaaattatgattagggggatcataagggaggacatataggaaaaaggataatcctcatggtgtggatttttacttgttgagttcacccccaacccctgtggatgggagagctggggagtcttggtccaaaactgttggaggcagttgttattagatggaggtggtgatgtggtagagtagagaaaggaaaaaaagaaaaaaatattccatggaacaatttatgactgaaattgaagacatgtttcctttctttttgagttcccttgtatttttgcaagaaggaatccctgagatagttctcttagagtcaatagatggtaaatgctcttaacctttgtatatctaaaaatgtttcattttgcatttactcttgagtggtaagtttagctgatgataaaattttggctgacagttattttcactcagcactttaaaagtagtattctgttgtcttctgtcatcttactgctgatgaaataaacatctgtcttcacttctttgtagattttaggaatatctttcctaaatttcacacaatatttctagatgttcatttatctttacttataatgctcagtatgtgaaatatacttttgatcatagaatttatgatcaaaattttttttgaaatttgttcatttctggaaaattctctgcttttatctttggatataaagaatcctgccatgctctgcatttgtttactgtagaatctctatcagatgtatgtttgagtcttacctctcattctttcctctctttccagcttttattttataattcgaattctgtgtgaactccttactattatcttccaatgcatcagtttctccttgactatgtgcattctagtttttgttagctattgagggttttgtttttgttttttgttttttgagacagagtctcgctctgttgcccaggctggagtgcagtggcgcgatctcagcgcactgcaacctccacctcccgggttcaagcgactctcctgcctcagcctcccaagtagctgggactacaggcatgtgccactatgtccagctaatttttgtatttttagtagagacagggtttcatcatgttggtcaggatggccttgatcttctgaccttgtgatccaccatcctcagcctcccaaagtgctgggattagagttgtgagccactgtgcctggcctgttgttgttttattgcctctttcaatactgaaatttccagttattttattcacatctccttgttcttatttcatttctccctgtttttgtttcacaattttctgttccttttcaatgtaaattatttctttgtctctttcagtattctaaacaagtttatttaaaggcttgacaaattgttaaacaattaagaaaaactttttgtcactcctccctctcccccttaaaatcaattttttttttttaacatggagtcttgctctgttgcccaggctggagtgcaggggtgtgatcttggctcactgcacccacggcttcccaggttcaagtgattcttgtgtctcagcctcctgagtagctgggattacaggcacatgccaccatgcccagctgctttttttgtttgtttgtttttgtattttttattagagatggggttagcctctgttggccaggctggtctcgaactcctgacctcaggtgatccacccacctcagccactcaaaaagtgctgggattatagatgtgagccaccatgcctggccaccttaaaattttgtcgttagtaaatttatgtcctgttgactagttttgttgactgaaggtttttttctcacagggtgtagaattttggtttgcagcattttggttgcagattcatgaggagtgtgttgttttgttttgacctccttgcctctggtccctccactactgtctgcaccttttgtcttacaggtttgcaattgtgcttgcttggccactctgactccagatttggaacttgagtgtgccttctcctgaggtgatactgggattgatacctagttttaaaataatgtccttgttaccagtaaatagattaggaaaggaatatctctgtatgtatgctacatatgccatagggtctgtcactgaattttgtagggaagtttgagttggttttgtgttgtctgggtctctaattctgtttgtttatatgaacgaataaggacggacagtccacattagtattttatacatttagctatgctttattctaataaaaaaagagttcattattgctctctttaaaatttgaccttcaatagagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtaggatattcctattccgttatttcagtttgtgtttgatactaatccttgatcatatggtataaattatttccttgaatatgcacaggaaaattttgttaaacacatgtaacatatgaaaagggtatttttttctagtcaaatattcttcatgatatatagaattctgctattctaatgtcaaatttgtttgtacagtcataaactgaatattactctgactcagttatgaaaatctgatatgtgggttacatatatagtcactttgcagaaactaaataaaacactgtgttacttagtactttgggtatctctgtgtgttctctgacttttggtagctggaataaatcctatactcacttgttcattcatttaacaagcatttactgcataccttcagatggtatgaacaatatatagaggatggctaacattttctttgcaatgtttcatgagatggtgctgtgtttggtggaataaagttatccctccagaaagtatgggagattcaaagctgttgtgtcatccaaaatattaaataaaaaagaccattttggtttaattgtagttgaagacaatatgctgtcttcagtgtaaagtgatactctgagatcatgccactgcactccagcctgggtgacagagcaaaactctgtctctaaataaataaataaataaataaacaaaactgaatggaatgatagccaagtgaatggagagatagcagagttttacatccctagaaagggtaggggctctagtgaatctgtttgcacagtcccctgacagtcaatagttgtcctgttaacactgctgaaattttccattgagatagttcttccttttctacacttagcaccttggcaaagggcactgatgagactctgaacagatctcagtatattgtgactgctgaaaatagtgcatatctcttgtttactgcaattgtgatttttaagatctttctttactaggaaagatttctgaaacctgttcctaaaatctcaaggagaatgtaaattatttatatttgtagtatattccatcttacagttgaaagaaattctgttgttttctttcatattaaaaaaaatgtacatgaaacattcaaatccaacactcctcatttagacatcgctgctggctcaattccagcattctttagaatcacacactgtcagagcaaaaagggaccttagaagtcctctagggccaggctgaattagtttacacaccaagtcagaaaggagtgtgaagctcccctccttcctgataagctagacaggggacttcttcaagctgtcagtctgcttttctatcctcttggtattactgctgataacttggctgtgtcatctctttcttaattgtcttagaattggcttccttggtcagtctgatcctgttaatcttctgtcctgtgcctccattttctaactaatctgcttgtctttctgttgtgagtgggatttcccctctaaatctatactttaaccccagtaatctccttcatatctgctaaggattagtaacaactggctcaccaggttggctttttggatcttgagaaaatcctggtcatcctttcatgcttggcaccaatagaagttgttttatataaggtacccaaataggtctaggcctctctcatccagtaagagacagacttattacatgtacacatgaaaggaagtggcttttctatttgctcttattctccttcgcttcccaaggcacatagagcaggtcaaagtggtatgtggtaaaataacaataattaatatttactgagggcttgccgtgtgtctgaaactatcctaagcacttcacatgtattagctcatttaattctcacctcagctgtgggggataggattatactgtcataagctatgtctaactctggatggatggatggatctctccacctgcttgttttaaggaaattaaaaatatcagacaaaataactattcaaagattgtttggaaaagctgttacttgtacatcatagagttataaagtcatcaagataatgccgattttagttaacttagatgaattaagtatggcaaatcttgctaactcgtgtattctaaaagaaaggcaagaaaaagtgaagcagaagtggttacaatagctgaaaaggtattgaagaatgttacttaaatttctcttttcttaccacccctaccacccccagattaggagtctcattctctctcaggatgaaaaaacattcttgctaatgtttagatgatacttctgtatttgagtatctgtaaatgtgtagggagagaggtgatatttagaattatctattggtagtaacagtggtattatagataccaaaggatataattttggtaacaataacctgagtatgtagatagttgattctgataaaactttcagttgtgatttgccctgttggatgccaaatcaaaatcattggaattttaagaacatttgcttagaaatctttcagccggctgggtgcagtggcttctacctgtaatcccagcattttgggaggccaaggcgggaaaattacttgagcccaggggtttgagaccagcctgcacaacattgcaaaaccctttctctacaaaaaaaatacaaaaaaaattcagctgggcttggtaatatgtacctgtggctactcgggaggctgaggtgggagggttccctgaggctggagaggttgaagctgcagtgagccatgatcacaccactgtaccccagcctggatgacagagcaagaccctgtctccaaaaaaaaaaaaaaaaaaaaaaaaagagaagtctttcaggagccttccctaagaaagaataaaaggacccaaaatgcatagagatgcatttgagcatttttcagaaaagaaaaaaaaaatctaaaaaaaatagctatattttcctagtatgaattcagataacgtgatttaacttttatcttaagtagattttttcaaacatattttagtggtcatagtcttagctttttactcctgtaatcatggggaattttcaatatagcaaaattgtgttctgattccaatgtaacatgttctaatcctgtacctgtttttttctattttatggatgtggattattgccattaaattttttttttgtgtgtgtgtataaattcatgcttattttaatacagacatagggtaaattagcctcaaatttttctgttttttcctcactatttgtaattgaagaatgagtagatatactacctttatcattttctttcttgtttatccattttataattttattaataatattttaattggcaaactctaattgtatacatctatggagtaccatgtgatgttttcatatgtgtatacaatgtggaatgattagatcaggctgattaacatacccaccaccttgtttacctatctttttatggtgacatatttgacattttactgaggtattttgaaatatacattatcattgactgtagtcactatgctgtgcagaagatctcaaacttaatcctctgtctgaaactttgtatcctttccccaacaattccccatttcctccccaccccacctccaccccaccctgacgctagtgaccatcattcctttctgtatagtttgttattagtattatagatgtgctactgatgtttgtatgttgattttgtatctgaatttatttcatcagttctaatagtttttacatggactctttatggttttcgctaagatcatattgtcagcaaatagagacagttttgctcagtccttacctattagaatatctcttatttcttttttcttgcctaattgctctgtctaggacttccagtactatgttgaaaaacacctttgtcctaattttgactaatgtatagtttggtaaaacccaggaatgcttttctataatagcacttatttgtatttatttctagattatacatatttttattcatctatcataaaactgattttcatgttcctacataattagttcctgttcagttttccagtttttgactattataaataatgtcatgaatatccttgcagacgaatcctcatatatagccatacttctttccccaaggtaaattctgatgttgatttgttgggatatttttccttttcttccttttttgtttttctggataccttgggcaacattttgggaaaataatttaagtattgcattattgacattcatttgttgtttatatgtggaagaggaaggaaaggggattaatatatattgagtgcttactatgtttctgccacttaacacaggttatcttttattgggcatacagtatgtgaggtggatagtaaatactcctcattttatagttgattaatatgaaacccagagagcttatataacttgagcagtcatttggctagtaggaaccaaagacagaaatcacaggtaggcatgtcttatttttttctttgtcacgccttgaagtctgtgggggaagatttatgtcaaaagcacattttcccatcatattaatgtgcttgtgaactatacctaacaaaggtttttaaaaattcagacataatgtgcagataataagccaggcatggtgggatgtgcctacagccccagctacttgtgaggctacagcaggaggattgcttaagcccaggagtttgaggtttcagtgagctatgatcgtgccaccacactccagcctgggcaacagagcaaaaccccatctcaaaaaaatatgaaataaaataacaaaataaaaaaataatttgcagataattttaactacatgtattcttatgtaatcaccaccccaaacagttatggaacattttcattactacagaaagttctcttacatgcatttccagtcagttgaaacaccacctctttcccccatgaggcaactactttctgatttccatctccacagtttagttttgctttttcttgaataccatatagatagaatcatacagtatgtattcttgcatattgaggttgtcctttgtgtgtatttttatttgatgctttctttggggacaggagaagatggtgttgatgtgcagtggggcaagttgccaatgaaattgaagttctgggacacttgctggctgtgcattacccgaaagtaaagagaagaggagagaatggatatatgttataaaaattatagctttggaaaataggtattctctccatttaactgttgaggtacctgaggctcagcaaagtgaattaataaggttgatttcttatagctagcgagcagtaaagctaaggcttgacatctggcgtatttaacctaaagccctttccacagtctaagaactgttttttgttttgttttttggtttttttttgaaggactgaaaaagacaatgctaaactgcctatctctctctgataactgaggtttggggaagccaagggtcagggttatcagaccaggaaacagaacaagtacttagagagctccaagtggagcagggagctagccaagcaggggaggtgggaaattgcttcattcttggcctggagccctcctggtagtttttgtaatgggttaaggcagtcctattccttcctgctttgaggacctccaggattcaaagggccagtgccttgcactttaggccaagactttgatgagactagcccaaggaagtcaaggttagtgttgggaaacgaatagttaatacatttctctttgtggagattcttctacatttatgttggaattgccgctcctctatgtgagaggccttcaactctcttcacaggccagtgttagtttcccagtcattctctgcttgttgcattccctaagtgtggttcctgatggaggtgagaaatagggttgggacagagaatgaaacataagttctactattacctaaatgaaatcaagatgtgggtaagggatttaaaggccattatatgaactcagtgggatagtattggtttgggtgggatatgagggctatagagctgtttatactgactaaaatgaaatctgtcacatacaaagaatccttaataagattatcagcagatttctcataataaactttggaggccagcaggcagtggactgatatattcaaagtgctaaaagaaaaaaactgtcaatcaagaatcctttatctggcaaaactgcctttcaaaagtgagagagaaattaaggcattcccagataaacaaaagttaaggaagttcattaccactagaactgccctgcatgaaatgctcaagggggtcctgcagggtgaaaagaaaggacactagacaataactcaacgctggataaagaaataaaaatctcaataaagataaatataagaacaattataaaagctaatattattgtaacaatgtttgttgttgttgttgtttgagatggagtctcgctctgtcacccaggctggaatacaatggtgccatctcggctcactgcaacctctccttcctgggttcaagtgattctcctgcctcagcctcctgagtaactgggattataggtgcctgccaccacgcccggctaatttttgtatttttagtagagacggggtttcaccatgttggccaggctggtcttgaactcctgacctcaggtgagccatccacctcggcctcccaaagtgctgggattacaggtgtgagccaccatacccggcctgttacaatgttttttttaactgtactctttgttttccatatgatttaagagactaatacattaaaaaaacagttattagtctaaaagctagtagtattgtaactttgttttgtagctccatattttgctttctatgtaatttaagagactaatgcattaaatatattagtgtatgttttggggcacaccatttatgaagatgtaattttgtgacatcaacaaccaaaaggggtgagtatggctctgttagacaagcagagattttgtatgttaatgaattttataatagacatatataaaacattctacccaacaacagcatacgtattcttcccaagtgcacatgggacattatctaggagagacaatatgatagatcgcaaattaagtctcagtagattcaaaaagatagatgtcatagaacgtatcttctctgactaccccaggatgaaattacaaatcaataacagatgtaaaactagaaaattcacaaaattatggaaagtaaacaacacactcttaatcaatggatcaaaaaagaaatcacaagagaaattagaaaatacttagagatgaatgaaaatgaaaatacagcataccaaaacttgtaggacacagcgaaagcattgctaaggaagaaatttataactctaaatgcttactttaaaacacaagaaatatttcaagtcaataacttaactttacaacttaaagagcaaactaaacccaaggctagcagaaggaagaaaataagaataaagattagaatagagataaatgaaatagaaagtagaaaaataataaagaaaaatcaatgaaactaaaaattaggtctttgaaaagattaataaaatggacaaacctttagatagatggactaaggaaaaaaagagaagattcagattactgaaatcagaaatgaaaatgggggacattactactgattctacagaaataaaaagattataagagaatattgtgaacaagtatatgtcaacaaagtagataacctagatgaaatagataaattcctagaaacacaaaacctaccaagactaaatcataaagaaacaagaaatctgaatagatgtataactagtaagtagatagaatcaggaatcaaaaatctcccaacaaagaaaagccgtggacctgatggattcactggtaaattgtatcaaacatttaaagaagtcacaacaatctttcttaaacttttccaaaaaattgaggaggaaggaacacctcttggctcatgctatgaggccagcattaccctgataccaaagccagacaaagacattacaagaaaaaaaaaaaaaacaaacaaaacacagaccaaaatctcttatgaatattgatgcaaaaacccttaacaaaatactagcaaattgattcactagcatattaaaaggattatacaccataaccaagtgggctctattcctggaatttgaggatggtttaacatatgaaatagatcaatataatatactacattaacagaatgaggggaaaaaaaaatctcacctgattatctcaattaatgttgaaaaagcatttgaaaaaattcagcacacattcctgatttaaaaagcactgaacaaagtaggaatggaaggaagcagcctcgacataataaaagccaggtatgaaaaacccacagcaaacatcatacttaatggtgaaagactgaaagcttcttttcttatttatttatttatttatttatttatttatttatttattgacaaagtgttgctctgttgcccaggctggagtgcagtggcatgatctctgctcactgcaacttccacctcccaggctcaagtaattctcctgtgttagcctcccaagtagctgggactacaggcacatgtcaccatgcccggctaatttttgtattattattattattattattattattattttagtagagatggggtttcactgtgttggccaggctggtcttgagcttctgaccttaggtgatccacccaccttgaccttccaaactgctgggattataggtgtgagccactgctcccagcctgaaagcttcttttctaagatcagaaacaattcaaggatgcttgctttcacttctgttcatcacagcactgaaagttcaaggcagagcaattatacaagaaaaagaagtaaaagacatccaaattggtaagaaataaaattatctgtttgcagatgatgtgatcttgtatgtagaaaatgctaaagagtccacgaaaaagctgttagaactaataaatgaattcagcatagtagcaggatgcaaagtcagcacacaaaaatcagctgcatttctgtacactaacagtgaacaatcccaaaaggaagttatgaaaacaattccatttacaatagcataaaaaatactttggaattaagttaactaaggaagtaaaaatcttggaccacaaaaactagaaaacatgatgaaagagattaaagaagatacaaataaatggaaacacatctcatgttcatggattgaaaaacttaacattgttaagttgtcagtactacccaaagtgatgtctggaattcagcgcagagactgcagtgaaaaaataaagaggatactcaaattactgaaatcagaaatgaaaatggggacattactactgattctacagaaataaaaagattataagagaatattgtgaacaagtgtatgccaacaaagtggataacctagatgaaacagacaaattcctagaaactcaaagcctaccaagactaaatcatgaagaaataggaaatctgaatggattggtttttctcagaaatagaaaaacctatcctaaaattcaaatggaatctcaagagaccctggatggcccaaacaacttttaaaaagaacaacaaagctaggggactcatgcttcctgatttcaaaacttaccacaaaactgtagtagtcaaaacagtgtggaactggcataaagacagacatacagaccaatagaattgaactaaaagctcagaaatctgtgtatatggtcaaaggatttttttttctttttttaagagacagtgtctcggctgggcacggtggctcatgcctgtaatcccagcactttgggaggatgaggtgggcagatcacctgaggtcaggacttcgagaccagcctggccaacatggtgaaaccccatctctacaaaaaaatacaaaaattagctgggcatggtggtgcacgcctgtagtcccagctattgaggaggctgaggcaggagaatcgcttgaacctgggaggcagaggttgcagtgagccgagattgtgccactgcattccatcctgggagacagagtgaaactctgtctcaaaaaaaaaaaaaaaaaagagacagtgtctcacactgtcgaacaggctggagtgcagtggcatgatcatagcttactgccactgcagctttgaactccggggctcaagcagccctcctgcctcagcttcctaagtaactaggaccacaggagcatgccaccacatctaacaattttttttttcctgtggagacagcgttttgctatgttgccaaggttgatctccatcccctgggctcaagcagcctgcccgcctctgcttcccaaagtgctgaaattacaagcgtgagcttctgtgcctgactcaaatgatttttgacaagggtgccaagactattcaatggggaaatttcaacaaattgtcctgggaaaactgcatatccacatgcaaaagaataaagttggacccttacctaacactgtatacacatgctaactcaaaatgaatcaaatacttaaatttaatagctacaactgtaaaactcttaaaagtaaacatagggcaagaactttataacggtagatttggcaatgatttcttggatatgacaccaaaagcacaggcaataaaaagaaaaaacagacaaattggactttgtgaaaatttaaaaattttgtgcaccaaaaacagtatcaacggagtaaaaagccaactcacagaatggaagaaaatatttgcaagtaatatatctgataagggaataatatccagaatatatagaggacttctaaaattcaatgacaacaaaaccccccaaacagcccaattaaaaaatgtgcaaaggagttgaatagacatttctccagagaagataaacaaatgaacaataagcacatgaaaagatgtgcagcaccactaatcattaaggaaatgcaaatcaaatgagataccaccttacacccactaggatggctactagaaaaaaaattaaaaaaaaaaaaatagaaaataggccaggcgcggtggctcacacctgtaatcccagcactttgggaggccaaggcgggcagatcatgaggtcaggagattgagaccatcctggctaacacagtaaaaccccatctctactaaaaatacaaaaaaatgaatggtggcgggcgcctgtagtcccagctatttgggagactgaggcaggagaatggagtggacccaggaggtggagcttgcagtgagccaagatggcgccactgcactccagcctgggcgacagagcgcgactccatctcaaaaaaaagaaagaaagaaaatggctgggcgcggtggctcacgcctgtaatcccagaactttgggaggccgaggcgggcggatcacgaggtcaggagatcgagaccatcctggctaacacggtgaagccctgtctctactaaaaatacaacaaaaattagccaggcgtggtggtgggcgcctgtggtcctagctactcgggaggctgaggcaggagaatggcatgaacccgggaggtggagcttaccgtgagccaagattgcaccactgcactccagcctgggcaacagagcgagactccagctcaaaaaaaaaaataataataataataataataataagtgttgacaaggacatggagaaattggaatccttgtgcgctgttggtgggaatgtaaaacagtacagctgctgtggaaaacagtatggtagttcctttaaaaatcgaaaatggaattaccatatggtccagcacttttacttctgggtatataccccaaagaatttaaagcaggatctcaaagagaaatgtgtatacttacattcatagcagcattattcacatagctaaaacctggaagcaacccaaatttccatctatggatgaatggatacacaaaatgtggtatgtacatacaatggaatattagtcttaaaaaggaaggaaattgtgacacatgctacaaaatggatgaacctggaggaggtttatgttaagtgaagtaaaccagtcacaaaaaaacaaatactgtatgattccacttacatgaagtacttagagtagtcaaaatcatagacacagaaagtagaatggtcgttggggctgaagagaggaggaatgaagagttatggtttaatggggtagagtttcagttttacaaggtgaaaatagttctggagatggatgctggtgatggttgtacaacattatgaatgtatttaatactgatgaattgtacatttaaaaatggttaagattctaaattgtatgttatgtgtattttactaaaatgagaaagagtagaggaaaaaaatctctctaagcatccaggtctaaaaagtttaccagattagtttatgatacaccaaacaaactccagatagactaaatctatgctaaatatttttaatctcatagaaaaattaggaatagggaatggaagtagatactgataaaagtgcttgaactctgaagcagtaaaagagagctggaatgaatttttatgatcacatttaaaaatatgtgacaagatatttgtaacaaataagaaagataaaaagctaataatatccttattatataaagagttaacatctgctgcaggaatgaaatggaacagaatagagaattcagaaacagattcaagtaggaatgagaatttaatacgtaataatgatggcattttaaatctgtgggataaaaataggatatttaatatgtattgaaatagctagccaaatgtttaggaccaaaagcttgaaaccaaaataaattcagttaaataaaatatttaaattggaatttcttgagaagcaggatgtgttgtagggaagagcacgtactctggagttaggcagcccatttctgccagtcactggctgcgtcgccttgggcaggttacttaaccactttgtgcctcagtttcatgaaatagggatgatagcgatacctgcctagtaggattcttgtgaggattaaataagttaatagactattaagaggagtaaatgagttaatatatgtaaagggcggggaacagtacctggcagatacatacaagtgctgttttttgtttttgtgttttttgagacggagtctcgccctgtcacccaggctggagtgcaatggcatgatctcagctcactgcaacctccgcctcccaggttcaagtgattctcctgcctcagcctcttgagtagctggccaggcatgccaccatgcctggctaattttttctatttttagtagagatggggtttcaccatgttggccaggctggtctcaaactcctgaccccatgatctgcccgccttggcctcccaaagtgctgggattacaggcgtgagccactgcacctgatcctttatttttattttatttttatcattatttttttgagacagagtctcgctctgtcgcccaggctggagtgcagtggcacaatctcggctctctgcaaccttcgccacctgggttcaagcaattctcctgcctcagcctcccaggtagccaggattacaggcatgcgccactatgcccagctaatttttgtatttttttagtagaaatggggtttcaccgtgttggccaggatgatctcaaactcctgacctcaagtgatccacctgcctcggcctcccaaagtgctgggattacagacgtgagccaccgtgcctggtcacaagtactgtttaaatgtagctcctctcatcatcattgtcatcattgaaaatgtgacaccatagaaacactaaaagaaagtatggcaaatatttttattcgcttggtgatgaaaaaaacattttttaccatgacaaaaagccatacttctaaggaaaagatcaagagatttgatatttaaaacttactcacgtgcaaaaataaggacttctggccagtgagtggggtactgtaggtcactagccatagtaagggtaggctgtgacagtgacattcatatgtttattgctttctgaactaaaaccagaaaatgatttccagaagccaggagagtgccctcggaagagtttttctcagtgttttaactgtcttagtctttctgcttaaaaatgcaatgttagttttctagggctacaataacaaattaccacaaacttgctgccttaaagcaaaagaagtttgttctccccactgagttctagagaccagaagtcaagttcgaaatcaaggtgttgacttggccatgttcctctgcagatgctagggaagagtctttctgcaccttttccagcttcttgtggctcctggcgttcctcggctgtggcaccctaactccaatcactgcctccattttcatctcctctcttctgtgtgttcccttcttctgaggaagaagtcattggaattaggccaaccctagtccagaatgacacctcatcttaactagttacattgcaaagaccctatttcaggtcagattctgaggttctgggtgcacgtgaattttgggggaatgttattcagcgcaccacagcttttgtgctctgtttcaggaagaaaacagttgtagcagtagcattgagaacagcggtgttcatgaagaggggagtagatccaatacctcactgggagctgttagtggtagcagaggtgacaggcacagagttacaccaagggaagaccagaaagacctcaaccactcctatgaaagtcttgcctttagtgaacaccaccagagatttgaacatctggaagtgacgaaagagctgatgagactaggaagggagttgatggaaaactaataaaacttttcaaaagagacaaaaacttagtcatatacaatattgggagataagactggaatcccaggtcatgtgggacaaattaggatttgtgagaagtttctgttattagtcttcagcagattatgacattccctgacataccctgaaagaatttgtgtatatggatatatgcatattctagaaagcggatggaaaactctcattagatccgcaagggtgtccagaaccccaaggaaaaaaaaaacagagattaaagaattatctttggagtagactgttagatttagtttccagatgaaaaggcaagtgggcctttgcttataaacatcatggattaaaatttacctttataacttgttacagtacaaaggggaaaatatcactaaatgcatttatttagttttttaaagttaccaatttttttaactttttaaaagttacctagtttttaaaagtttttaagttacctagtttttaaaagttaccaatgttttaaactgtgtataaataatttttaaaacttccttttctcctattatcacccccatttctctggtgctctttttgtagtcaatccgtcaagacaggagtctctccacattatttctgcttcctctcctcatcctctttggaacttacaccattgcagttttatctcccctagtccacttagagtgctgttgtcaagttccgacttgccacatccagtggacagttgctggtcctcaggtttccagcaatattaaacaccattgctttctcctttcttctccgttggcttccagaattccacacttcttatcacaccagctgctgcatcctaatcttctttgcagactcatcctcatcttcccttctctgtgagaacaacctcaagttcagtcctcaattatttttcttccccatatatattgctacccaagggggctcatctattcccttggttttcttctcaccctcctgagaatacatattataaaaacaagttacaagattttctgcacatgaccctttaactctttttcacatagtctattcaatttgtttattttatcatggttgtacttttggatgtcttaatttttttcctgttggctcgtatttccctggggtattgtctgttcaactggtaatatgtacttgatgggaggggctaaagcccaggacctaacgtgtgaccttcctggtgaggctgggccacagggggagctcacccattggatacactttgccactgccacctcccaccatcaccaagtggcctggttcctcaggaaacctcccttaccttcactagacattgctcttttccaatgcccatcttcctgagtagttatctaacctcagtgagtggagggcaaagtagaagggcactcttaggcgccggccaggctgcccaagcccttgctgtctgctctccaccctagcctggtcttctgccttgatgtgcacatatggtccctgccttgcactgggctggcactgctgtttcagtctctccatgctgatggtaaatgtcatggatagtaggatgtggaagaaaaagggacagataaacacttttctcagcccatctgtgaaccttagcacctagcacttttccacctgagctgtgttctccaccatattaggatccaacccacttctgtctccccagggtttctcacatgttttactgtactttttcagatcattaactttctcttttttcaagcaaggttgatgttgtgcaaggttaggattcagaaggagttggcaacttgtgttcctttataatgaagattaacaataaaacttcacgttggggaaaaatgagctcagtacaaaataagaaaaaaatgtaggccgggcacggtggctcatgcctgtaatcccagcactttgggaggctaagattggtggatcacctgaggtcaggaatgaccagcctggccaacatggcgaaaacccatctctactaaaaatacaaagaattagccaggtgtggtggcatgcatctgtagtcccagctactcgggaggctgaggcatgagaatcgcttgaactctggcattggaggttgcagtgagccgagattgtgccactgcactccagcctgggcgacagagcgagactccatctcaattaaaaaaaaaaaaaagaaaaaaatgcaaatttcttagaaaggaaatatatttagtcaataaacatttggaaatgtttaaggaaatggaaaagtttaacttaactaataatgaaagaaacatagttcagaataatagctgtatataccttttgtagaataaaatatcaaagattaaaaaattttatatactcagtgctggtaatatgcaattaaatgacattttcatacacagtactattcattggcacctaatttgatttagctcttttagagaatacctcatttatctcgagtcttaaaatatttattctcttaactccataattccattcctggaattctaacctaaggaaaggttcagtaataaaaaagtctttaggcacaaagatatgcactaaagtgttttatttatactactactgataatggtggcagcacatggaaacagcctagtgatctaagcgcaggggaattgctaaatagattatggtctatcagtccagtggaatatcttgaatctatcaaaatactatacttaaagggtatgtggaaaacatgaaaaaaattctatagcctaatgttacagtgaaaaaggaagataaaacagtttacataatattatattataaaacttacacataataaaaagattagaaagaaatttactctgttagtaatgtttgtgattggccgatggacccaataagcataatgttacagtgaaaaaggagataaaacagtttatatagtattataatataaaacttacatataataaaaagattagaaagaaatttattctaatgttagtagtgtttgtgattggccgatgaacccaataagaattttcttttttaaattttgtattagctctgacatgggggaaattctaattttaaaaaaaaattacaaaaacaaaacccattctggttctggttgattcgagatttagcaaagaaatgataaaagttactagcatacatatttcataaaagagaaacctttccaatgtaaaagaacttaatagaaaggaagaaagaggagaggggagctgtgctttgtaaattgatgtagcaaatgcttgataacaggatccaggactcagactgaattcagattcaagcctgaagcctgctttccctcggtatgacctgggagaggttcttcagctcctctgtgctccagtttgttcatctgcacaatgcacataaaaatagcatcatcctcatagggttgctgggtgggttacatgtgctcacagagcatgtggcacataggaagggctatatatgtaagaggtgttatctgcctcattgttttcatctcctcatccttatctaagctcaggagtcacaggtcactggtgatcagaatccagcttcatgactcacttgctgtgtaaccatgagaaagtttgttttacctctttaagcctcaggttttttatttgtaaagtaggggtaataaagtacctgcttcctagggttattgtgagaatttaatgaaatcgggtaggtcacgtgcttagcacagggtttggcacaaagcgagtgctcacagcagaagtagtagggaggtatcaagagctgacaccatggtggtgaattctgtttgagttctgttttgaaccatgaggaaacatggaagtaagctaacaggcagggcagtacagtgagtgagccagcaatgtggtgttactgtccacttccaacagagtaaggtagttgaggatcaatgataattgtaatagtttatatgtttatattgcttcacacttttcaaacctcttacctgtatattggcccctttgatggaacagttctgtaatgtagtggacagaaagcctgtgctcattactgctatttaccaggctcctagtcccttccccatgttcatgacctacttcagcaactatgtatcctcctctccattctagatctagctgatcttgatacttggtgtttaggtagataatatctccagtactttggacataacagaggccttagtctttatttcagtgacaacccatccctgtggctatatcttgggtcctgtttccccaagagtcattccacctctaaaatcttaaacttcaattttctactcttgagccacttattacatatgtagtaatttatagttttgacttgttgctgataggttaattacttataacaatttacatgtaacagtgggtaaaaacattcacctatttaaattttttttcacttttgatgaggcaaaggggtatagtgctggtaaatttgtagactacccaagaggaaattgtactcatgggtgattcatttaatcaaagaaatactatcgtaacactctttactccttttaatctcaaatatctattttctaaagaaaggttatatatatgttacattaaaagttactgcttttgcagtcagtctggataaccagaatttgaattttctgacttagtgggaataaaaatgataatattagccagtaagttatacaattactgtaatggtttttaaaaataattgctatcagaggctgaggcgggcagatcacgaggtcaggagatcgagaccatcctggctaacacggtgaaaccccatctctactaaaaatacagaaaaaattagccgggcatggtggcacgcgcctgtagtcccagctactcgggaggctgaggcaggagaatcgcttgaaccaagaggcagaggttgcagtgagccaagatcgcgccactgcactccagcttgaccgacagcgagactttgtctcaaagaaaaaaaaaaagttgatatcactctagaaccactttttaagattgaatattagcttcatttattaatgtacttaaataacactacatatttttacttcactttatgaggttttcttaagtacagggaataattttaaattaatttttattgaaatgtagtgtacatacagaaaagtatgcaaatcataagtaaacataagaattttttcttcgtgaaaacacctgtgtaaccaggtgagtcagagcattaccagcactccccatattccccaaaccctcccttccttcttttagtcaccactacccccaaataccctcaaggtaatcaccactatgggacattaaaggcaagtctaataaatgaatattcatgtgtgtcatcatttttttcttcttctttgccaatctttagatgtatttatgtctgctttttctctgtttttaaatgtatattaaaataacagatatatagttttacaagccaaataatagtaaaaggctcattacaaagtataccaatttccttctttacccctccttactcttcaaaatccttctcccaaaaaaggagaaaccctttagcgtctcttctgctacttgcacatttccatatttcatattaatagttactatattgctgttattttttaattaaacaaaatgaggcattatttgttgacttcttcttatctttttataataaatgagaactgtcataccggcacttccactacttctctttctcatcatcctaatatatctattttaacaattttggttaaacaaatacactaaatgcctatgcaaaggatattgaaaattagtattataggatactatgattatggggggtttctcttcattttttgtgatgttaataatcgtcttggtttttatgttttttctttctttttaagcctcttgtctgaaatcatgatctctcctgccttccttgttctggctttggttctggattatggtcactcacccttaatgattgccaaatccaggtgaatcttccattcctgatcctttgtagatcgactttccttgtaactttctccttccttggtttccatgacatcactttcttacctttctggccactccttttcagttcgatgagtgagttctctacttgccctctttttttttttttttttttttggagacagagtttcgctcttgttatccaggatggcatgcagtggcgcaatctcagctcactgcaacctcccctcctgggttcaagtgattctcctgcctcagcctcccaaatagctgggattacaggtacccaccaccacaccctgctaatttttttgtatttttagtagagacagggtttcaccatgttggccaggctggtcttgaattcccgacctcatgtgatccgcctacctctgcctcccagagtgctgggattacaggcgtgagccactacgcccaacctacttgccctcttcttaaatgttgtgttctttaagattctatcctcagccttattcttgcccaacacagtctctttaggcaatatctgccatgaccctcaatgactctcgttatctattcctccaatgtggaactcttttctaagctccaggcccagctatttcactggccattgaacatgcagatggggagcgtgaaacaaattggttattgcctccctcctctctcttctggtggtatctgcatatgaactgggcagaggcattcagtatctgccctacctacagttctatcccctgtctaccccccacaacagacagaagcttcacctccttgcccttctgcagttcccttcatgcccctgcaaacacacacacatacacagaggaggcacaaatgcactttaccaactttttccctccttaatgccaggactacagctcttcatttttattggcaagaacaccaaaagctgtctctccccacatcgtctccccagtaggctaaagtgaagggataggatgttgagccaactgtgggattccagaagaagcaaagcatcactcattagtgtgtttcatttgtacatgttagtaactattttaatagaccatctttttcaaaacatgttaatacctgacatgcttatagaatgatcacttgaaacaagcagtacacattcagactgtttcttctgcattgttactttcagatttaaaacaccagtgggattgtaatatgaatttcattactttaagagtcaaaggtacacatgtgggattgtaatgtgaatttacagacagagatgatgtaccttgtcaaaacaagaaaaaagcacaactgaattttctgtcttcttttatgactgtatataattaagaccatgaatctgagttcacattcctaaaagtatccatgttccagaggagcccctactcctcagccacatctcatgcacggatcagaatgttctaggaggagacagcaagatctcacactggttgcatttctctcagctacgctttctgaaagagttgtattcattcagtctttcaggcacaattatttattgagtcagtgcaattgcaatatgccaggcactatattaaacactggtgatacagaatgataaaatgccatcctctccctgcagttcacggtaaaattaaagatgtgggcagctgtctcttggagccttgcttctcgaagtgtgccctgcagaccgtcaacatcagcatcacctgggagcttgttggaaatgcagaatcttggtccaagatggatcagcatttttatccaggattctgcatttctaacaagctctgatgccagtgctgtcggtccatggactgcactgactagcatggtgttacagtactttcctcaagctggttcttttgctgtcccaccatcaaaggagtggaagattgcggttgtgttttctgtgccttcagatacacagcctaatgtagatatgacagatgtgcctttttataatataacctggtgcagactgcagtttaatccatctgtcagcattcaaagcatctgggatagaatgtgtaaaggctgactgatgataataagatagccaagaagttaggccgggcgcagtggctcatgcctgtaatcccagcactttgggaggccaaggcgggtgggtcacgaggtcaggagttcaagaccagcctggccaacatagtgaaaccccatctctactaaaaatacaaaaattagccaggcatggtggcgctcacctgtagtcccagctacttgggaggctgaggcaggagaatcacttgagcccgggaggcggaagttgtggtgctgagatcataccactgcactccagcctgggcaacagagtaagactctgtctcaaaaaaaaaaaaaaaatggtgagccaacctgaggtagttggaaagagaagagatacttgctagatacttcgcatgcctaatgcaaatgcattaacggttcatcatttagtaattaggaggggctaggacctctttaagcggagttagaaggttattatagcagcccagatggaagttaatgaggcctgaacttaggtaggagaagctgtatttaggattgttttcaacaacgttgttttcaatgttgtcctaaataggacattaggaatgttgaaaacattgggaaggttgaaaatcaaacaaatcaacattaggaatgttgaaaatcaaattagtagttgtggcagaagtgggagataatctaggttgatgctcaggttattggctttgggaactgtgtggataggctcacctagagattacaggaagaagatcaatttgagatctatgtttcactttggatagatggagagggatattggtgtaacctgtctggtaggtattgaggtgcacagtcctggagctccagaggggaatctggctggagctgcatagacactagtgaagccaactcagcaatatatatgaagctataggtgtggatccaatcattcagagagaatgttccaggtgagaagagccaagcaccaaacatggggccctttgaatgaaagaagaaccctctctggaagcttttgaagggacatcagagaggtagtcaccatgagatcctagagagtgctttaggattgaattttattttgcttttcaaaagcttaaaggtgatactcttaacaagtttcataaggtttttcattgtcattgtctttgatgatggtgagatagctctttgtttttgttattgtttgttggtttctaacttaccagtttgttctgtgcatttttaaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcaagtccttcattcctcctgagtccttgcctttcgtttgaacatgttgtagtagatctacttttttgatgggtggaggaagagtttaacaatctgaaagataagattagtatgcttaagttcagttctgattcagtctttaacctacgtactttgaattgtgggctggttaaaacttgtaacattcatctttttatttaccatgaagttttcttacatagttgttccctgtttcctgcaaaagggcctcttgaaatggccacccctactaaatctgcagcagagttggcttttgttatttactccatacccctttctgcaggcaccttgctaaagactacagtagatgggtacaaggagagaaggagtatttagatctgagatggggattaggaaaagaaaagagaaaaatgaacaagataaagatcttggaagagaacttttaagtcaaaacataatacttttacaaaggttgccctgccctttctcacaagtgcgatagaacaccagttccactcaagttatgcctttagcctcttatcttagaacttaaaggagcctgcagagtttccaaagttggaataattgttttatgtttcttttcaaaacacccacaacaaatcaaatgtactccttgcgtgggtttggaattagccacggcacagctaatctgtgggattcttagccattctctcctccctcaatccacacagctggcttccaccgtggccttgtcagcccagagaacgtgtatcacctgcacacatgcacaccctactttcatgtccttccatttctccttgaattatggactttcttgcatatatggaattaagagtacccagaattctctgacctgtgacttctccctcaaggatttgaaagagggtgcattaaacatctgtgagattacatatatctaccagcagtttcattgttttaaccaagttcatgcctcattctctaaacaggttttttaaactgatggctacaaatgctgagaaaatctgtatatttacagatttccaaacctggcctttatatctttctggttacagggaagtgtctcaatccaggtacatccatttgatttcttgccacggcttgttgccgttgggtgtgcatttccaccccttctttggtgagagtaatagacgctgtgctgtacaacacagatgctgctttttcacattggaattagttccatatgacttccaggaaacagagtttgaaatgtgaattctacttgttattctgaatgttgttctttctccttcctcaggcattccagtgcctctcaaaggcatacaagtgtgacacccagtccaattgttgggagaaagatattacatcatttaaggaagttgttcaaagagccttaggacttgcacatggtatttgatgtaacatttgatatccatggaatgttttgacttattttctactgacagaaaagagtgttggtcaaaagtaaagttccattataaatagtatcaaattatttcattatattgacattgttgtatttaattcagcaaacattcatagaccacctactatgtaataggcattttgaaataagaagaagaaacaggatagaggcttatattctgttggagtaagtaacagaaattggaaacttttttagagatgtgaaacatctttacaactttgtataaccttcattccacactgagtttcactgtattgattacatagcattaaggaaatctgttaattttaacttgactcacacatagatctctggggtacatagcagtatgcagagctgtagcatatacaaaagaaatataaaataaaagccttatctttgggaaatggtagaggatattgtttgaggaaaggtttaaccttacatataaaattatatgcctgttgggtaaatatagtccaaataagcattgcttttagttattaatttttaaaaatgccagttaaatttggtaatgcatttttatatttatatttgaatatgggtgtgtgatgcagttccaataaaataatgatgcccccaatgttaagaactgaatcacaaagaccttacaccaatcctaaagttctccttctacttccctgcctaactaacttccttgctgccactaataattacaacaaatagggagcaaacaaggaagaatgcaaagggcagagctttaagatcagggagacctaagctccaggaccagctctatcacatgcttgctagttgaccttgggtaaataatttaacttctctgagccttactttcctcatcagtaaaatgggataatacctacccatgaagaataaatgaaaacattcaaacacttagcagtatttcacacatggtttagatattaataccctaccctctcaccaccaccctcttccttccaaagtagaggacttgagctatagatgataagggactcaaaactaaaaaaacaaaaattaagaacaaggataaagtttggcttgcttataaagaagtcacagaacattcagaaaatttagaaattagcttggtagttgataattctacttttgacctttgatatctttgacctaaaggatataaatatctaatttcctgggtcaccaagcacttggcagagaaggtagaagtgctgagctctatatagctgaaagtcaatgtagaaaagttgggggtaattgctaatagagccgtagaaggatgttttgggggtggttagaattcatgtggcttctactgacctcatgatgggtgggctcagttgggatccagtccttatgcttttggtctttgtggatattgtatgatatttggggaaacccacactgatgtattaggtacataattagcaggatgggatttactttgaaaaatttatcttatctacttcaacttgccaactctaagcatttctatgaactgctcgtctgtaacagtcaaagccacgctattttctgaactcaccaagtaatggtattaaacctgtcaaagagagatatgcaggttaaagagatactctaggaaaaatctttattttgcatcttaaagttgggtttaaactgttattggcattattttcttcatcagggcaatacttggagaaaaacaagtgtccattcttttaagttctcctctgacatcattgaattatgtgttcatgctcctacaacattttaagcgtatttgagtggatgcccagctttcgtttctgatgatattttagatttacaaagataaatcttaatcatttccttgttacttttgtaccttagtgcagaaagaataagctggatttctctgtgtatgagtctcttcaaaacattgttcctccaccccacccaattataaaaaggaaatacaatcaagcatcccatagcaacattttggtcaccagtggacccacatatatgacagtggccccataatattgtaaaaccatatttttactgtaccttcccaatgtttagatagacaaatacttaccattgtgttctgattgcctgcagtgttcagtacagtcacatgctgtacagggttgtagcctaggagtagtaggctatataccatgtagctaggtgcatagtaggctataccatctaggtttgtgtaagtacaccctatgatgttctcacaacaacaaaattgcctcaccacacatttcttacaccgtatccccatcattaagtgatgcatgactgaataacatttttaaaaatctccacatggtttactccttgggttgctatcattaaggtagccatgcacttcagaaagcttgataagatattgcgaccttgacatagtatttgaggcctccctataacaatgtcatcattgtgtgctcatttgtattgtctggaaggtatacatttatagtttctgctatttgattttctgggaaagggtgggctaaagtgtttcagctctttgccatccaggagtttttaaaataagagttaatgcattttaactgcagtttacatagaggaggcactgctgcttcagatttttttttttttttttttttttttttttttgagacggagtcttgctctgtcgcccaggctggagtgcagtggcgcgatctcggctcactgcaagcttcgcctcccaggttcacgccattctcctgcctcagcctcccaagccagctgggactacaggcgcccaccaccacgcccggctaattttttgtatttttaatagagacagggtttcaccgtgttagccagaatggtctcaatctccttaccttgtgatccgcccgcctcagcctcccaaagtgctggcagattttctgatgatttgaaacagcaagttatttctctccctctagctgtctgtctctatctcagtctataatgccttttggaaatgggattgagtaggaaaactaatagagtatatctgtctttttgctttacttttgtttttgtcagaatgaaaataagggattaaaaaagaaatacagcagtttctgatctaaactgctgggtactaaacagctcaaataccgctgccatggtggttacaactttcctctactaagagaaacagattaataatccccgctatctctgggctaactctgccttttgaaaatgggcttaacattgctaattattatgcatcctctcaccctttaatgagaaatgtcaaagtctaattattattcctcattattactctaagataggaatgtcaaacctagttcttgctggccttggaagatattaattaatgacagaactctgttttgccaggcacaggcagcctctaccgattgattagtctttgcgtgcaaaaagaaatctattgggctgggtatggtgtctcatgcctgtaattgggaggctgaggtgggtggatcacttgagcccaggagttcaatatcagcctgagcaacatagtgagaccccatctctaccaaaaaattaaaaaattaaaacattagctggttgtggtgacatgcacctgtggtcccagctacttgagaggctgaggtaggagaatcacttgaatcctgcaggttgaggctgcagtgagccatgattgtgtcactgcactccagcctcggtgacagagcgagaccttgtctcaaaaaaaaaaaaaaattgattttctatccttggtctacaatctagagtataaagtagactttaatccttgcgctgtttagtgtcattttaaaggagtatctgattattggtctgtttgaatttagtgagcataatttagggaacaaaaccaagaacaagccagtggggaaatattgggcattatgtttgtacaaagctcttcactcgttctcataaagcattaatagccaggccttctaccaggaagaacgatgccttcttcgtagtttcaggttttgggaaaatgagttccccagaatgctgggagcagagttgtgattcactcttgcccattccctgctgatgccaagccttgctcaggaacttaagaacctggttgtggtcgcgttctctacatgaagacacatgggttgctgtcagtgcttcctgaatggtgcttcaaaccctgattatgaaaatgcagtaagaattgagctgtacagatctggcatgtcacttccttgggcttgtgtcatcagcagttgtgaagtccccattggggacttggtagcatggaaagccacacaaagatgtgctgcatctgtttttgtctgtgtgggtactttgttttcaataatattttgtctccttgcctaattttatttgtctatgcacatgtgtgcgtgtgtgtgctcgaatgcatgcgtgtatatgtgtttagggtctcttcccagtgatccgtaactcaccaaaaatcacctgtttttcccaaaattccctggagcagtaaattaccattcttaaagaaggatagagaaaggccaggtgcaatggctgacacctgtaatctcagtgctttgggaggctgcagcaggagactagcttgaggccagtagttcaaggctgtatgccacacctccagactgagcgacagggtgagaccctgtatcttaaaaaaaaaaaagaagaagaagaagaagaaggataaagggaaaagctatgtacataattattattctttttcaacaataaaaactttccaggtagaagtgtttctaaagtatgttactataaaaattctaattaaataattggcttttgtacctgtgaattattattaacactttttaatggatgtttctctccatacttatcttccagtggccataaaatgcagtaaaaacaaatccagttcccaagaagctgtacaaatgctttcttctgttcgactcaatttacggggcttgttatctaaagcaaaggtgagagtgacatgtgaattaattggaattgtcatatagaaaaaggtcattagtatcagcttattgctgttaaatcttcttttacatcagtgataattttaggcgcatgttttatttaatatagcagccccctcatggttggttgtgttgtgaggatactattggcctaatggatagaccactctaaatgtgtatgacttaagagtctttgaaattgtctgggtgcagtggctcatgcctgtaatcccagcactttgggaggccaaggcaggcagatcatttgaggttgggagtttgagaccagcctggccaacatggtgaaaccccatctctactaaaaaatacagaaattagctgggcatggttgcgggtgtctgtaatcccagccactcaggaggctgaggcaggagaatctcttgaacccgggaggcagaggttgcagtgagccgaaattgcaccactgcacttcagcctgggtgacagagtgagataccatgtcccaaaaaaaaaaaaagtctttgaaactaatgtttacaattcagcccttaatgctttccttaaattaaaataaaacaatgctcttgtatttattgtcattttcccccaaagtgtggcatatatgctactggtaaacttctggtttaaatatatattcatttcagtacatattagaaaaaaagcagactagctcatcaagcctataatttcatgaatattattgcttattttgtatttaaagttgcaatgtaatgtttccttttagaaagactcttaagtaaaaaaattgacttagataaaaatattaagtaggtcgtatatggatgtgagcaaaattgttaaggtagatggctattgaggtttgacaactgaaatacgccattagttcacaaaaactaacttgtgtaccagtgctgggccagagatgcctaagaatcactcagggagctttattgaagactggattgattcttgggctctatctgtgaccgatgtagattcaggtctgggatggacccaggaaatctgttgaatttcctatgtgattttactctgcagccaggtttggattatacctctggaagcaaaatttggacaaatataacttctagcacaatttagcacttacttttctagcctttacttgctttcactattgcatcttgggttgcaaagtaattttgacttacttccgagagtaagtctctggcacagggaggccatttctgaatacctttttactctgtaaccgcctttctgagtatttttttgttcttattaatggtttgatcttttcagatcaaggcatcatttttgcctctttaaataattaacttacttcacttttcctatttatctgcatgacccaggagaactatatttcctcctagcttggcagcacaacttcaaaattgtgtctctcggaaatctataagagccccctcaaagtcagagcagcagggttttttcctgtgactttccttcccaaagtgggagctttgtttcctacttttgatcagtgatctaatcaaagtagtttacttctactactaccacagtagtttacttcttcagggtatactgtggcttccttttgtctgtgcaaagctttttcttacaaattactactttatgtaatctatacttgcatgacttgaatagtattgtctgtgcaggtactgcacaccttcccatattatggtagattcccacataatgaaaatgcggccccagaacatcatctgtgtttagattttcattctcattagatgccaactggattatccaaaaatgggaaaaattacctcccagtgcctcctctgaagcatatttcacatatatttgggagtctctggtttcgtagatcttatgccttttctatttaatgaattaggtttgtcaaactgaattgcattccaaaaaagtcacttttttagaatactttaaaaagtgaaaatgaagattgaaaatgaatgaggataactatgttaaattgcttgcagcctatgttaaataggcttaattgaatgaatctcaggtcttttcttgccaggccagggacttcatggaaataagctcctagtacctagagactcacctaacaaatcatccagtccatgctctcccaggacagagtgactcccctgcccatttgcaccctgtccttgtacaggtttgctgccaagagtggcatgaaggggctgttcatgagagtgctggagagcctggacacagaacagatttgaccccttacagtctttgggactctcagcaaattattcacttttttctaagcctcagtttctccgtgcttcctccttaccccacagggaagtgatgccgattgattatgatttgcaagcactgtaattcttagtttaaaaacgcacacacaaaaaccaaaaaaactatgtgaggctaggttattttcctaaaaggtgttttctctgctgatgacattggagcagttcctacttcattttgttatgaaatgctgtacaaatcatgtagtcaaatccagtgaaacagatatttggcaagctacataaatgatatttctgaataaaacatatacacagtcgcatgtacacacgtgcacatgtgtgcacacatacacataccatggggtcataaaatcctgaagttgattttcttgggggcctatgttggctcagcaggcagttcctggagaggcatttccaaatgttttcagctgtggtagcatgattgaaatatgttgcaataaacctcccaaggcaattcctttttcagggagaggacacagttatttttattttgctggacttttttgctaggataatctttgtggtctctgaggcctaagcgaaattaattttcaagtaagtagcataaagggtatgatttatatgaatttgaacatagaatatatttgttttgcctgcatacacaataaataaagtcattttgtttagttgaattatgtctgttcattcaaaaaccatcctataacattgaaatgaataatgagaatttaggcaaatgcgttgaagagcagagctcatttgaatttataagttcaggcatgttgttttgattcaccctttaattattttagcttgtacatttcttggctagtgaacagaaaaaaatgctaccattgctattataattgtatagtattattatgcaaaaggttttttaactctatactctgtatctattttattttaaagaaatttgtgttgttttaatacttctgctttgttttttatattacagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaacattcttggttttgtgatgttttcaattttatatgctttctgaagtatattaaatttttaaaactccctatttcgttaggtctaattatagttgagttcagtatttttattcttgaggtattttggcacaaagagcaattaaattaattttgtttttaatatagtgtttattctctttcaacctaacattaattggatcatactttggaaaaccttttgtctaaacaggtgaaaatcacgtactacaagtttgtgaaatcattagattgactgctttattgttcaaaagtgataaaagagtggacttggagctagaaacatttatgtttcttgagattttgtgcttgtttcagaaagatacagacttggcgaaattggaaatgtgagcatggtttaacttctaaatcaagaaaatgcaagaaaaaaatggcataacctaaatttttgcttagttactaggaactaggctgttaccccttcattatgtatacaaccggccccaaagatagttgtttaattagggtattatgggtgaagacagctattaatggtgccatattacagaaatgcgaaagtaaaatgctttcaatgtctatggagccaaatattgaaggcagcagctgagcttaataatcttagtacaaaagtcatagtgaggaattctaagtcctggcttgggttgctacattttgggtcccatgtataaatcacttggcccttttttttttttccatgttcttatatataagatgtaaataatttctactcgtagcctctttgtgagtttcaattgcctttggaaacttaaaaattcataatccattaagtatcctgaacatttaaaaaccatctttaaaaaacccttttattagtgaattttgattatgaatgcttaccagtgctaaatgctctcatttcttaaccactgcttcttttctattagcatattgccttaaaaagaagttggcatatgccccaaagcagtttctcttatagcagagacaatacctgtgagaaagaccaataaaatgagttaacattaagggtctacataaaccttttatagaagtcattgaggaatagatgggtgaatggatgggtggatgcttgaatgggtggatggaacaagattttaagattaatttttattagtatcaagctgtgaaccctaatagaaagtggacagaaaataaatactgaaaaggacaatcatttcagcagtcaagtagaagactgaagtagagcatcaaagttgtagaagtttttggtcttcagtttgctttccttgggttcaaggtagaaaggcatcagtgattgtgagaagtcacaaaccaagtcacagaagagctatctccttgcagtcatgttctccaatgctgtgctggacaaaatcaaagtaatatatatattactcttttatcttggagtgatctcacaaaagtgagagctactagatgttttctttaaaggcatagacctattattattattattttttaatcttacttaggtgagtgtttaagataattgaagaaaatgtgtggggaggtaaagtagggaaagcttggggttttctaaaagcctcatctctgctacctaacatttaatatttaatttagctacttggttttttcatctgacaaatgagtgtgatgataatagtacttttcatcaagttgttcctatctcttaaaaaacattttcacctagcctcagagttagtgatacagaatctgtatacactccagcctgggtgacagagcaagaccctgtttcaaaaaacaaaaagcaaaaaaccttaaaacaatgctgtattatttattatacgatctttggtgctttgtgttgatatattatggttaaatgcttgtgtttccaaatgccttatgttttataagtttcactttggtttccaattattaacacttttgctttcagaattattcttttgcttttccaattagaaaaatagaaaagatgtgattctttaatcttactgccttcccagagtgtgaataataattataatagctacaagttattgagttctcactatgtaccaggcatttcacctggcatcatctttgaccatcaaaagagccctgctaggtctgttcgtgatatcactagaaaactaagggtcacaaactctagaaagagaaagagccaggatttgaagactactaaagcctgcattgtttctgctttcgctgaagcttccagttgaccactgatttcaatcttctctttctaataatgggatctggacagtttgcccagcatcatttataaagttctccaagagaaattctgtgaggtctctgttaataatagcctgtggtttgttaagattatttactcttggccgggcacggtggctcacgcctgtaatcccagcactttgggaggccgaggcgggtgaatcacctgaggtcaggagttcaagaccagtgtggccaacatggtgaaaccctgtctctaataaaaatacaaaaaaattagccgagcatggcggtgggtgcctgtaatcccagctactcaggaggctgaggcaggacaatcgcttgaacccgggaggcggaggtttcagtgagccgagattgcgccactacactccagtctgggcaacaagagcaaaactccatttcaaaaaaaaaaaaaaaaaaaaatatatatatatatatatatatatgtaatttactctttttgaataaaaagttttaataaattcctcaccagcttttccccagaggtagcataataagcatagtaaatggggcccctaactgcaaaagagagaagataggcttcagtggaatacctaaatgcaaactcaagaagcttgcagcgatggtattgagactggaaggcagagcagtggccgtgtgttgagaggtgggagcaggtgggactcagagctcagattcccagagtggacgttgaagtccccatttaggggtggaaggcttggacccacctaggatggagccttagcacagatgaggacacagccattgaaagcatcgacttatttgactgtgttatcaagactgttcttatgctgtacttgtttctcttgggcatgccattagtgtggtattcataagcagaaatgtaaaaaagaaatgacaagaagtatgtgtagtaaatccacctactttccagacttagttcaaagattatgacctaagcagaggtctggttagtttaggctttgtgaacgtttgtccaaattatagtaggtttactagctaaaaaccctgggtgagtctgatgaaaagtatttctttttttccattgctgtttttgtaacatccacatcaatctaaattgctgtttagataaggtaactctactttactggccaagagtgaggaataaaatctgttaagtggatgcaacacacttcctttctgcctattcattcaaaaggccctatagtgaaatggcaaagagcctttattcaaatggtgggtgccatgctgtggtaatacagatggatttttcacaacatgcagaagtgcttataaatagatacgtttcaatcaacaagtagcttattcaggcatgtgctcaaatatagtagctgcattcattagacagacatttccactaatcccaagactatactaataaaagagtaatcccttatgggctaaaggtggtgctggtttgcttttaactcttggagtccttcacacaccaaggcctaataataattgtagctgtatttggttttcaccaagtgaacttaacccatttatgccggaggttgcaatttttaaaatttttgcaatcagagcttggtgatgaccttgagcagtagaatataaataactctcacacgcttagcgttccgataatggaacactaagcataaatgggttaaaagccgagcttatcttggaatttttctattcttatttttttaaattgcaggagcttagtgaagaaagaggtgctttttactctagatatgtagctttcagcaaagccaattcaaaaatcagtttgtgtgtgtgtatgttttctcgatactttatcataaagcacttgtctctttcaccttggttcatagaagtgttcgcttgagcagattctgttttgttctttgatgttaggataaataacaatggtcagttttgagagcatttgcaagctctcactatagtggtttgcctttttacgtggactttttccccttcaatagctctttactcctcctatgttactcagagctagctgtaatccgtttgcttagcacaacaccaaaatctttcccttgccagtggtgtcaaatctgccttcctttttattattctgacttataaactgcagtgacctctgagtcaacttcgccatctcttggccctgtgccaacattgtgttctgtgaaaagagagtcctgccaagggctacgaggcagaaaactgatattattaaagtggtcttctgaacggtaagtatcagccattttctaatcttttgtgatgttattgccagaaagggggaggggggggtaaatcatgttaatgttgttaaggatctaacccatgcattgctaactttttccagatcgagggctcagatgcacatcagtatctataggcacacagaaattattgcacagcgctgttcacagacagatgtgcttcttgaagactctattactgtgagactcgaagaagtttcttaatgtctgagcctcagttccattatctgtagcctgttagtgatccatattgtacaggggtgttatatacaataccagttgagaagatgcatataaagtgctttaaaaataaatgatatagaaacatgatgcaagcaagagtgtcttcgaaaccatttgattattaacactgacaaccttttctgtgccccactcagaagcctgatgacattcagtgctgctgggctgtgataccaaaatgtttattagcattttcattctatagcaaccttttccccatttctgggtggcaagtggtgataagggaagggataaagaagaaaacatgatggatttttatgaagtaaacgagaaagaaccaagttcccatcattaggatttctcaggttggtgctaagaaaaggaaagaaaaagaggatggggagtaacaggcaaaagcaaaacaaaaaactgatgaaatggggaagtggctgactaggatgaagtcagagaattagaagacctggatgaagtctcagctttaccgcctcctagctgtgaccacacctgagctcctgaacctctcagccccaatttcctcagctataaaaatgcaaatacccaccctacagaccagactgaatttatcagatgatgtatgtgaagtactatgtgagcaactgtgtacaattagttattgttatgatcaagagaaaggggcattgtggatggtctatcggttcccaggggctggtggagtccctggataggagtatgcagcaacttggctccagtttctgtaatcccatgggggtcagaaccctggggtttgagaaacaatgctgcagaatatctttcagtcttgtccttcatcactctatttactgaatcaatttggcctagaggatatctggtgccagggttgataaaagctgtcttgggatttttacagctgtctggtcagaagacatgcttatgccataacagctccagctccttctctcactctctctctctctctctcacacacacacacacacacacacacacacacacacgaacagcactagaatgtgctttacatatgaagttgattcccctgatcattatcagtaggacatagggtgatttcttcagataggtatgctctgattaatgttcaccctcctcctttaataaattgcagaagtgtcccatgtttatctccaaaaaattagaaaatacaaataagcaagaagaaaaaaaatcatccaaaatcccacccctgtagaagttaaccctgttaacttttttgtatatccttccagactattatataaataaatacacatatatctgagagatattggctttttgtttgtttttacttaattaagcttttcagtaaaacacatggaagcaggcccttcattaacatttgtggagctccaggccagagtacatatagaggcctgcttactatatatctaaatatttcaaagttaaaaatcaagcaaagaaatggttaaataaaatttgttttatgctttgatcttgacagatattcctttataatgacttggaaggacatattttaatttggagttctcaaacatctcagaattcaaccaaaaaggggtgcagagagagtcagctcccttcccctatcctgcttttcagggtcccaagtacacatgtgcacactccagctgcaggtgtcaggcatgtcttcagcacccacaaacagctctgcatggctaccactcagacctgggagtgcacagaccagacgccactccaccctcaggattatgggcacagaagagaggcacatgcagcttctggatgcaggctttgggcctgtgggcagggaactcctggggtcccagttacctgagcgtggtctagaagatggggctaatacaggctctaggcataagcaaaaagtgtctggaggagggacagaaacagaaagtcccaaagcatagggatttcttgccttggtttaagggtggtactgacgggaaaatggtgtcagatacaggagttgttgggaagaacacctattcctctttccttaatattccttgaaagtgagaaaatttctgttccacaaggtaggaagcaaaagaaaaggagcctctctctactccatatttattccaagggaggaggagcaacttaaggaactaaggaaccagacaaatccaactctctctctccctctttgtgtctgtgtgtgtgtgtgtgtgtgtgtgtgtgtgtgtgtatctctttctgtgtctctctcaagataggtaaaaccatgacactgttggcatttgggctggataattctttgttgttgggagctgtcctgtgaatttttattttttatttatttatatttatttatttatttatttatttgagacggagtcttgttctgttacccaggctagagtgcagtggcgcaatccccactcaccgtaacctccgcctcctgggttcaagcgattctcctgcctcagcctcccaggtagcttggactacaggcatgcgccaccacgcccagctaatttttgtatttttagtagagatggggtttcaccattttggccaggatggtctcaatctcctgaactcgtgatccatctcagcagatcacgacaccccaagtgtctcctgggggacaaaattaccctcttttgagaaccagtaggttaaacaacagattagacagataaggagagaattagtgaagggaaggatagctctagagataattcagcacattctacatcagacagggagagaaataaaagtaggtaagagacacagaggatagatttccagaagaatatatctaatcagaatttcagaaggatatgaaagagaattgggaagaagtatttgaagagttaatggctgacagttcttcagaattgatgaaaattattctcaaaatcagaatatccacatagactttaaaatcacctctcaatttacacatacgcatagcctacaggatttttaaaaggaaaaagttttaaattataccatttataatggcatgaaaaattcagatactttgcaataaatatttttaaagattgataaaggcacatatatcagcaggaaaaaacattttcaggcagactatacattatatgtgttgaaacatcactatagcccataaatatctgcatgttattatatgtcaattagaaaataaaataactcttaaaaagtcctaaatttaaaaatggtgggaaataccatgttgatgaattggtaaactcagtatagtaaagatgttgtttttcctcaaattgatctatatattcaatagtcttaataaaaattccagtctacttttttgtggaaattaaaaatatgattctaaaacatacaggttgagcatcccaaattctgtatctagaaaaccttatagtccttccttcagctgataaacaacttcagcaaagtttcaggatacaaaattaatatacaaaaatcagtaacattcctatgtaccaacaaccagccaagctgagaaccaaatcagaaacaccatcccattcacaattgccccaaaaagaataaaataccaaggaatacagctaacgagggaggtgaaagatctctgcaatgagagtacaaaacactgctcagagaaaccaaagataacatgagcaaatggaaaacatcccatgttcatggataggaagaatcaatatcattaaaatggcgatactgcccaaaacaatttatagattcaatgctatttgtatcaaactaccaatgacattcttcaaaaactagaaaaaactattttaaaattcatatggaaccaaaaaggagcccaaatagccaaggcaatcctaagcaaaaagaacaaagctggagacatcatgttacccaacttcaaactatactacatggctacaggagcaaaaacagcatggtatttgtataaaaacaacacataaaccaatggaacagaatagagagcccagaaataaggctgcacacctacaaccatctgatcttcaacaaagctgacaaaagcaatggggaaaggaatccttattcaatgaatggtgctgggataactggttagccatatgcagaagattgaaactggaccccttccttataccatattaaaaaaaaatcaactcaagttggattaaagatttaaatgtaaaccccaaaactataaaaaccctggaagacaacctaggctataccatcctggacataagaacaggcaaagatttcatgacaaagacaccaaaagcaattgcaacaaaagcaaaaatggacaaatgggacctaattaagagcatctgcacagcaaaagaaactatcaacagagtaaagagaaaacctacagatagagagaaaatttttgcaaactatgcatctgacaaaggtctaatatccagcagctataaggaacttaaacaaatttacaagaaaaaaaaacactaaaaagtgaacaaaggacatgaacagacactcttctaaagaagacatgcatgcagccaacaagcatatggaaagaagctcaatatcactgatcattagagaagtgcaaatcaatacaatgagatgccatctcaaacccagaatagctgttattacagagtcaaaaaataagatactggtgagactgcagagaaaagggaacacttaatatactgctggtggcagtataaattcgttcaatcattgtggaaagcagtatggtaattttcctaaagacagaaaatccattcaacccagcaatctcattactaggtatatacctaggggaatataaatcattctaccataaagacacatgcacatgaatgttcattgcagcactattcaaatatcaaagacatggaatcaacctaaatgcccatcaacggcagattggataaagaaaatgtggtacatatacagcatggaatactgtgcagccacaagaaaaaatgagatcatatcttttgtgggaacatggatggagctgaaggtcactatccttagcaaactaacgcaggaacagaaaaccaaatactgcgtgttctcacttataagtgggagctaaatgatgagaactcatagacacgaagggaacaacatacactggggcctacttgaggatagagactgggaggagggagaggagcagaaaaaataactactgggaactaggcttagtacctgggtgatgaaataatctgaacaacaaaccccccctccacgacacaagtttacttatataacaaacctgcacatacacccctgaacctaaaagaaaagtttaaaaatgtaaaaactatatatcaataagaaaaaaatcaagtgggaaaaaacaagtattttgcaaaagaggataatatccaaagaaaaatacaaaaatacactcagtcatcagagaaatgcaaattaaaataaagagataggaccacatactcaaaagaatggctaacgttaaaatgactctgcataccaagtgttaggatgtggagtaggagtaactcttaacaatgctaatgggagcaccacttgatagaaacactccggaaaacagctgggcaatatctgcaaacttcgaagatatgcataccctatggctgaacagttttactcctggggtgcacacacatacccaagcacaaatgcaggcaccaaaactctcatacaaaaatgcttatagcagcgttatctataatagtccccaaattgagaaaatctaaatatctaccaacagtaaaatagatgcataaatggtgggatattcatgcaatgatgtggtctgcatcagtgaaagtgaatgttctagccataccacggcaataacatgagtgaatctctccaacactatgttcagcaaaggaagccagatgttaaaaacattaaaaatttaaaaagtgcatgctgcatatttccacatatataataagttcaaaaagcagattaaattaaactgtgttatttagtgatgcatgcttagtataaaaactataaaggaaagcaatgaagtgatcaccaccaaagacaggctaatgactactcttgtgggtataaatgggtggtggatgaatggtactaaaggacttccggggagctggcagtatcatagttattaactgggctcatggctaacatggttcttctggcaaatcatcaagttatacatttttgttttgtgcattcttcccaaatgtgtgttgtgtttcacagtaaaaagcattaagatattaggaagagtgcagtcaactcttaatgtgaacctgaatgtctgccttctcctctccacgtttttgcacttttctacctctttgtcttttccttctttttgaggagacctgagctctttcctcaagtaatttttctcacaactcataaaattgacttttgaaaaatcatactgcattttgaggtgaaacttggcaacacaaacccaaacttaactccatgtaactttaactccccacccacccccactaccaaacacctccttaaacaaaatataacaacattttacaactataaggtgcttttaccctaaggcaaaaatgtggataatttgacattgcactctaaattctttatttcttttgtctaatacagttaagatcctgtgctgtctggataaataggggggtactaacctaaggcaacccaggccagcataggcagtgattgagtgtggtcatcttggtgaccaaagccagcttctcacatttcttcttgaaaagcatggtgctgacatgtttaatatcctatggcattccctttgggctctgtagactgatggaaaaggcccctgttaacatctgatggccaagttgaatagcacagccttgagaccctccacttcacagctccggttaggggggtgatttctcaccaagttgtagtagaaataccgatagtcatatcctggcaggatccacataccaccggttatagggagaacacttttgtgtgcctggatggttttggacaaacaaaggtgaaatctcacccacaacttcatagggaatgataaatcaaaatccagcacactacaaaaaagaaaaagataaagctaaggtttgaagtttttctggaagaattccaaaaatgcatatttcaagggaatgtctcagggcaaccctaaatagactggtgacctacagatcaaagacactgtattttattagccgtctcctgacccagccaatccaactgtccttccctaactgttacatgcatccagataaaccctcccctgtctgtctttactttcttcctccgagaatcacaaatcaaccctgacaacatttggtttctcatcttaaggaatgttgctggtacattctttatgtgaaagaggcaatcccaggaaggggtatgaaccagactgaatgaagagtatcttatttcatctgcacagaacaaaagagtgtctttcctttcccaatgcctgcaagagtctaaggacttgaatgaaagcagactggctgagcttagtcctaaggatggatacaaggctggcagggaagaggggttctctggggtctgtggggtgactttccttcctccatgattgttcttataatggagtcctgtcttgctaaggggagcagtgactgacagggttatttatctttgactgcttccccacactgatcccacgttcttttttttttttttttttttttttttttggagacagagttttgctcttgttgcccaggctggagtgcaatggcgcgatcttgctcactgcaaactccgcctcctgggttcaagcgattctcctgcctcggtctcccaagtagctgggattacaggcatgcaccaccacgcccaactaattttgtatttttagtagagacggggtttcaccatgttgatcccaagttctataggtacggttgggatataattattttgaaatgttatgagtgtttcataagtttactctgacctgggaattttgtgaagtgtcaatgtggcaggcagcctgaaagacggttcccagtgatctctggctcctggtattctcagccttgtggaatccccatccctggagtgccttgtgtctatataaaatattgacaacattgaaaggatgtcatttctatgagtaggttacataagacagtgacttctatcttgcgagcagaaacacttcctggctgcctttgataaagcaagccaccattcgggagaggaccatgtggtcaggaactagggatggccttgggccaactgtccccatagccctgaaggaagcaaggagctgaggaagtcaggtggcccagcaaccctaaaggaaccaaatcctgccaacaaacacctgagcttgggggcaaacccagatgggccttcagatgagaccctagcccaggctgacatcttgactgcagctctgtgatagaccctgaggttagtcctggctcatctgtgcctggatttctctccctcagaaaccatgagataataaatgtgtgtggtttttaagttgctaactgtatcttagcactgcattataaagcagtaggtaattaatacagtagatttcacttagtcactaattattacaaaatatatttctggatacattttatcatctcaaagataatagatggacaaaataattaaactggatatgctttcactctatgtcacattgtgtcaaaataagtcatctccttagagaattatttgtaaactaacagattatataagggcaggcattaagaagcctctgtggtctaaaatgtgactcctctgattaaagaccttctggagttctgcatgaaatacatactctttgctgtgacattcataatgtgactccaaaccaccctcccaagattcttccccatcacaccactccttgttggtaccttatgcccaaggggtggttcctgaccaccctttccacactgcagcctgccctccccatctgtcttttctcctgctgcccttctggtgctctccctgctttactctacctcatgtctgctgtggaaagcctgtctcctcaagaccaccccttcgtgagatttcttacaggtcccacatccacctctaagccgggtactctgcctcttccccttacactgcaacaccacttttggccttgtttagggtatttgcatgctcttcccctcatcctgatttgctctctgactcttctctgattcagcctcttctgatttcccatgtgagaccaaaagctacatgagggcagaaactgtccctcattcttggtggcccttcctacaacctagaacatctccttgggcatagtgaagagatggtcacacagtgtttgcagaattgaatttcatgaagggcagattgtgatgtggtgcagcattacctagatggtgttaacagaatttctgtgttaacagagattctatggccaaagtagtgtgagaaaccaagtgcgctctgtccctttgctatggtttggataattgtccccagcaaatctcattgtgaaatttgatccaaatgttggaggtggaacctaatgggaggtgtttgggtcatggcagtggatccctcctgaatagattaatggcctccctcaggggtgagtgagttctcactctgttagttctcaagagagctggtgtttagaaagagcctggcacctcccctctctcttctgcttcctctctcaccacgtgttctcttcacacacaggctccccttcactttctttttttctttttaaacagacggggtttcactttgttgcccaggctggtctcaaattcctgggctcaagtaattcacccaccttggcctcccaaagtgctgggattacaggagtgagccaccgtgcctgtccccctttgctttccatcatgagtagaagcagcctgaagtcctcaccagatgcatatgccagtgccgtgcttcctgtacagcctgcagaactgcagaggcaaataaactccttttcattataaatcacccagcctcagctatttctttatagcaacacaaaatggactaagacaccctccatgaagagccgccctgggcattagatgactaaagtctctaagaagctctgcagtaaagaaacaggcagagcccaacattccactctggctttctgtaatgctgtgatttgggcagaaggtgtggaagctgcctacttacctctctacgggatctctgcccatgtagagctcacctgagagcggatgctgtatgttttgttttgttcttttctctcaataaggctgtgagtttatcacactttgtagtctatactcatttcccttgtttagtcacaggtgattccagggcgatttcaattgatgatgcttcgaacggatactcaactcctaaaaatacacaaatcccgctgttagaaactaagccacttctattgcatttagaaccgtatttaataactagtttgacatggtgactcctgtcctcaagggactttttgctcaagagtgcagtgactaaagatttcagatattagacacccactttttcaccagtctttgccagatttaattctatttaatggatgttgaataagcctttcccatgtgtcaggcactatgctagatgcttagggtacaaaacgtaataataaactgttcctgccctaaagaatgtctattctgactcagagcataacatattattttaatatacttctgcgagtgctgaaactctgttatcacctgcacataagcaggagatggggaggcaccagttgaaggcgcttagctgagaggaaagggggaacctgggatgagagttagttgaaagatgcagaaaagttaccctgagaataaaggtagcagaaagaaaatctaatttaactttttttttttttttaatatactctctgccagcaactctctgcaaggtcctaagggttctaagttgaataaggcccactccctcccttccaggactttagctgaggttggttggggcagaagtcgggcaagactcatcggaacggattaacagagacagaatccagaggcaacggggtgaattccaagtataggtaatacttctaattttaatttaaataatcatttatttcctctaagctttattattttttaagagctagcatcattcctctgggtgtcttgagcctgtagactcagcagctgtgaattgaagaatttctgtctggttcctggtcaccttttccctgctgaaaacactgtccctcccttctctctcttcttgtgcttcacttccatgaaggagggcattagaagaaaggaaaaggaaaagtgcttccctccctctgtgctcctggcaactctaatggtaggatctgttttggaggacttgctgtaaagcgatggcagttagccacgtctggaacctatgtccatggctgaaagagccacaggctctgccgtcaggagacctgtgttagttttgtctctgctattcactgattgtgtgcgcctggcatgttaactaaggctctgtgtgtttaccttatcttcaagatggggtaaaaagatactcacaggggtgtgtgcagattagtgcttatgcgctgagcacactgtccaaaaggctattttagatgtaattctcttcctctttttctttaaatcagaaaagacacacttggtctgagggtatgtttcagctcaggcatgctgccatcaggaccacgtaaagctggatttttctacgctagtccatttgcacgtaagctcctcctttctcctccgaagtacaattgttatacctagtagttgggaaaattgtgtcattgtgtttgtacctaacacagatgacttaggaatttttttctactccttggatttatcttctcattttctctgggttaccttgagaaggacaagaagctggtgtttatattggcgtgcaggattgagagagaacataaaaatgggtgggacatatatatgccgtgatggatggagtcgtgaacacttttggcttaaaaatcaaatttcctttgctattatactcaggtcaaggaagcaccaattacttcaggtctttcctggagtaattaattcacctataatgccttcctctcctcccttcctgttatcccttcccagtagcttgtttttctttattcaaagaacatatactgagggctcttagggacacacactgtactagggggagagctcccaggaaaaggcagcaggggcaggaggaaattgcggggagaggcacacaggcgctcacagcccccatccttgtctgagtctgacacatctgtcctgggtggctcttgaagagctccacagatgcagtaataagagaaagggggcaggaaagggccctgggctgcaaggatcagaaggcgataactcagagaggtggagtgagtgggcacaggccccacaggatgaactgtgcagagaggactgagggggcagcagcagaaccagcctggctggtggtgatggggacagcccaggccaatgggggtgacttgcggaagagtggagagaaaccagcaagtgcgtggccatcggtggggcctgctctcctcactcttctccgcaggtctgacccctttcattttagctccagataatgagtttccatcacttcatttaggaaagcaccaaatgggacgggccctgttttgggactggggatgcaaacacaagcaggaccttgtcactgctcccagggagcccgccgcgtggtgctgcggttcctgttcagggctgcgtagcagaatcaccccggggagcttttaaaacacacaccatccggagattcagattcagcaggacagggtggggctgccatttccctatctgctggtgaacctcgagctaatgaaaatagaaagagaaggacgaggaggtcaacacccctgttttccaggcactgtgctaagtgctttatataagaggaagtgaaatatatgaacagtggtgtgcttccgctggctcacaccagcccggaggggtcaactctgtacctttcttctcaacttgacattcagtgacatcacactagtactttgaaatgagccctggtgggaatattacagcatggaaatggacaaatgctaaacaccggggcattttcccctctagaaagccagttgttaaacatttaccagaacaccactgtgtatatgtatgtttcttatttagtgtaatcttcataataaacccagatattatccatggactaacacttgacagctttcaaatcacttttaaatacgttgccctactctcgcaatgccccgtgaggtatccttgtccccattttaaagaaacattggctccaagaggtcacacggccaggaagggacagacctgacatgaaaggccaagcttgcctcctatcagccttgttcctgctatggcaggcccagcaggcagatttctggttctgagccagggtcctggtcacaggggctggagggactaggcctgaccccgttctcagatgtctgataacaggaagtttccccccaacactgggaggcttagcttaataaatgagtttcctgttctgcttatttgcgtacattgaggattctcatgctacgtttgggcctacataggcaggcttccaggggcctccaattcaggggcttgctgtttccagggggactggctgtgctagggaaatgtgcccttggctgccatggaaagaagggaatctagaactttttaaaacctgccccttcaaggtcttggccaaggccatgggaatttccaaatatttcacttgtcccaattgaggtagcaatgaggacgctttgctagaatgaggcttagagatttatgtccccatggaaaatccccagaagtgagggaaactcattctaaaatgtcgaaaatagcagcaaaccgaaccagccctcacagatatcacctgctgtagaaacagagtgtcctgaggaagaaggcaagaagaaattcctaattcccagggtctctctccccataatttaggttttgtcaggacctactggtatctgttgggacagacaactgagtgaaaagctagtcgtcatggaaaaatcagtgaaagacctttttaagacagaattttccttcatgttaggggtttggacagctggggctattccactcacatgatgcccactctgattaccgcactcagaattcttagtttgtctcatattcagtcgccactacctggagtttccacagagggtgtcaaaggtgacctcccttacattctgaaggatgtcctgtctgagggatgggctcccagaggtcactagatgggaatagtggtgtgtattgctgaggaccccagaggttttagaacggaaggacttgacgccatgggcttgctggtgggaggtggatgatcccttaccaagctgtggcctcacaccctcctatgctcccgaccacccccagcactggcttgactccagtgtgaatctttcttttcttttgaatcctaaacacatgtcccctgaagtgtttcagacagttgggatcagcagcaaccctagcagtgtttgtgcagaacccccagagctgacactgctgactgggacatgtgacctggcacccccaggtgggtgggccccaggtgagtccacccgggctccagcagaggaacctgcctccggagttcggaggctgtgatgcgtggtaccgatggactctgagttccagactcgggacacaaggggagatggaaggcaactgtgtaaaccaaagaggcagcagcaggaaggtcccagcgaaagcagatccactggccagaattccccaaagcctctctgcagtgtggttctcagaccagcagcatcaactcacttggggacttgttagaaatgaatctgcctgtcagtgagaggcccaggggttcctgtgcttgacggcactgcactaaacaaagctgagcctttgctaactcctctaggtctctacccactggctaagactcggccaagggcacatctagggctggagtattatacagtgagcagaagatgtatgcaacttaaagaataatgttaaggagtgggggaatgctgatttttttctctgcctctcttgtatattctatcataaaggatctggactcagaagagatttaagtttcaaatctggctttgtcagttaatgcttgtgggatctcaaccacgtcactgacttctctgagcatgcttccatatttctacaaaggaaacaataggtgactctgctgagttgagcacttgcgagtaccaagcagtaagtgttttacacctatttactcatttaatcctcctgaaaatccgtgtgacacctgtgttgttattacccccatttgacaggtgaggacctgaggcacagatgctaaccagcttgctggagatcacacactcatgagtggcagagtggggcttggaaccgggtagcctggctctggagccctcactccatccacacaccatgctgggacccagtcgagtgaccagcagaccggttgtgtgggttaggtggaatggtggatataaaccacacagcccagctcctgacccatgctgggccctcagtaagttactactttcattattatacatgcgtagatgaaagttgggtggtaatagtgattttccctaagatgatggaactttacgtgcctttgccttttcttacctgtatattcctgaaatcaacaggttctacttttgtcacaagaagagaggaaataattgtacttttttttttttgagatggagtctcaatctgtcacccaggctggggtgcagtggcacaatctcggctcactgcaacctccgcctcctgggttcacgccattctcctgcctcagcctcccgagtagctgggactacaggcgcccgccaccacgcctggctaattttttgtattttttagtagagacggggtttcaccatgttagccccttgatatggttaggccttgtgtccccacccaaatctcatcttgaattataatccctgtaattctcataagcttcacatgtcaagggagagaccaggtggaggtaattgaatcatgggggtagttccccatgctgttcttgtgatagtgagttctcacgagatctgatgattttatacgtgtttggtagttcctcctgaattccttctcattcctgccgccttctgaagaaggtgccttgcttccccttcaccttctgccgtgattgtaactttcctgaggcctccccagccatgctgaactgtgagtcaattaaaactcttccctttataaatttataaatttataaattctttatagcagtgtgaaacgggactaatacacccttcttgacttgcttatgtgacttgcttatgtgacttgctcatttccagcatgaggcaggaaaggatagaagcctttcagagcctgagccaagttcctcctcacagaagcacagaggacacttactccatctctgaaaaagctgcccacaccccacctccatccagccttccaaaagccaccacgaatgacccgtaggaggggcagagtgtgccacttgctacggaccagaacctctggggagcggggatcatctctgtgtctctctgcttcaactgcatttaaaatgaacattcttaatgataaacctttccgtgtgtaaagaagggcgtggaaaaatgtatgtactggagactcgggtaatgactttctaagtgtggaaaattttcccccaaagtgtttccaaatatagaaaagtcacataataaatgatgagggctcataaacctttctggcagcagttgcaggggtcagaacaaggaagaaggaattcccagctcctagggcctcgcatcccacactgtcttctgggctactgtgcaaccaatggttccgtatctgtacgtacccaggggctccttagataaataattgaagtgaaatatcaaatgtgttactggttttttaatgtcactgataaaacccctaaaatagactgcatgtctcccagctcttctgaaccaggagtgtttgggaagttgagaatgtcactggtcacattgttcctttctcttgtgtctctaaagggttttgttgttttaggtttgttaatggttgtcaaacacatgcctcagacatttttaacctcctggaagcctactggactcaacacactgaaaccagccctgattctctgctgactgcatttgccaagattgagtcctataattgtcaggttgctgccaaagctaaagccctgccccacctgccccgccccgccacccacctgccccaccccaccgcccatagccttccctgagaaccatcttcaacttcttggcagctgtgattctcctcacctctatgggtggaggaaaccagtaggggtgcagaagatcagggggttgtggaaacctgcatcttcttcatgctccccaaacctttcttccttgaagcaaggaagggcctagctctgtcacagaaagggtactgaaagacataacagaaatgcccaaccaaatggagattatgagtgaatgtggtcactgggatcacagctggccctaacaggtctattctaactattctaactctggtgagcccccaaagaatgagggaccccctcagacgctcccaatttatcacttcaaaaatcttcgaagagctcccagagaaaccctggagcttacacaggcctccagaacaaggcaggagttttggtcctggacagataaccttgtcagagcatcagagacacaggcaccatgttgggtatgagcaagtccctcttgaccaccctctcccctcattttatgaacagagaaagtagctctcatgtccggagagactaccaagaagccctgggcatgtgttttgactcagaaagtcctagaagagtagacagaaaggtcaccatgttattttaaacccaaacttgatacttggatgtattcatggcctggcatataagagctgagaaatacctccccactccacttgtcacagctcaagtcctcacccatgtatcagtttgaggtttgggctctaggttttgagatagaatgaaggatccaaagagttcccaagaagatggaaagctatgatacataaagaaaggatgaagattaagcctatgcattcaaagttcttgtgacccatggaaaaaataaaaataaaacccaagcagaatgctgaaatgcattgtgattcctaagcttgggaagaaaaagccacaggatgataaaatctctgtgtttaagtaaaagaaggagactggttatctgaagagtgctgatctgttttctattatcagctaattccatgattttattgccactctctcctgagtttctatcatgggcagtgtaggcattgaatcagagaatcttctatgggaaaactcagagttcaattcaggggagtgatgccgagggacagagttatctccatggctcatgcaaacaagggcctctcaggtattagtggtactttttaagcctacccagtgacaacacatggtggagaatcagggttccattctagagaggaggcttgaaagacatgttggctaagagaaaagtaaggaaatacatcatctccaggttacttaataatataatttggctgtgtccccattctaatctcatcttgaattcccatgtgttgtgggagggacccggtgggaggtaattgaatcatgggggcaaatatttcccgtgctgttcttgtgatagtgaataggtctcatgagatcggatggtttcataaagaggagtttctctgcacaagctttctctcttagtctgctgccatccgtgtaagaaatgatgtgctcctcctggccttctgccattattgtgagtcctccccagccatgtggcactgtaagtccattaaacctctttcttttgtaaattgtccattcttgggtatgtctttatcagcagcatgaaaacagactaatacagtaaatttttgacagtagagtggggcactgctgaaaagatacccaaaaatgtggaaatggactttggaactgggcaatggggagaggttggaacagtttggagggctcagaagaagacaggaaaatgtgggaaagtttggaacctcctagaggcttatcgaatggctttgaccaaaatgctgataacgatatgacaatgaaatccaggctgaggtggtctcagatggagaggagggacttgttgggaactggagcaaaggtgactcttgttatgttttagcaaagcgactggtagcattttgcccctgccctagagatttgtgaaactttgaacttgagagtatctggcagaagaaatttcttattttttttctttctttctttctttctttttctttttttttttttttgataccaagtcttgctctgttgccaggctggagtgcagtggtgtgatcttggctcactgcaaccttaggcggaagaaatttctaagcagcaaagcattcaagaggtgacttgggtgctgttaaaggcattgagttttaaaagggaatcagagcataaaagttcagaaaatttgcaacctgacaatgtgatagaaaagaaaatcccatttttccgaggagaaattcatgctggctgcagaaatttgcataagtaatgagaagctgaatgttaatccccaagacaatggggaaatgtctccagggcatgtcagaggtcttcacagcagcacctcccatcacaggcccggaggcctaggaggaaaaagtgggtttgtaggctgggcccagtgtctcctgctgtgtgcagcctaaggacttggtgccctatgtcccagctgctccagctatggctgaaaggggccaacatagagctcagcccatggcttcagagtgcaatccccagcccttggcagcttccatgtggtgttgagcctgtgagtgcacagaagtcaagaattggggtttgggaacctccacctagatttcagaagatgtatggaaatccctggatgctcaggcagaagtttgctgcaggggtgggacccccatggagaatctctggtagggcagtgcagaagggagatgtggggtcagagcccccatacagagtccccactggggctgtaagagggctaccgtcctccagaccccagaatggtatatccaccaatagcttgcaccatttgcctggaaaagctgcagtcactcaacgccagcccatgaaagcagccaggagggaggctgtaccctgcaaagccacaggggtggagctgcccaagaccatgggaacccacctcttgcattggcatgacctgggtttgagacatggagtcaaaggagatcattttggagttttaagatttgactgccctgctggatttcagacttgcatgggtactgtagcctctttgttttggccaatctctcccatttggaatgggtgtatttacccaatgcctgtatccccattgtatttaggaagtaactaactcatttttgattttacagactgataggtggaagggacttgccttccctcagatgagactttgtagacttttgagttaatgctaaaatgagttaagactttgggggactgttaggaaggcatgattggttttgaaatgtgaggacatgagatttgggatgcaccaggggcagaatgatatggtttgtctgtgtccccacccaaatctcatcttgaatccccacgggttgtgggaggaaccccgtgggaggtaactgaatcatggggggaagtatttaccatgctgttctcgtgatagtgaacaagtctcatgacatctgatggttttataaagaggagttcccttacacaagctctctgtctttgcctgctaccatccatgtaagatgtgacttgctcctccttgccttccaccatgattgtgagtcctccctagccatgaggaagtataagtccattaaacctctttcttttgtaaattgcccagtctcgggtatgtctttatcagcagtgtgaaaatggactaatacacttaaatattgaataaaggctatgaaagaaagagtagggttttcttgggggatcttaaggatgatacccactttccttgtttaagaatcctcttgcctggggatgaagggctccacttatttttaggtgtctacagtgtaatagaactctgaggacagaaatccaactctgattagctttggcaaaggggcagatatttgaggctcacataaccagtctccaagggggtagggatgtggttgatctggggacatctagaaccagggagtggcatgccactagcactctgtctcacctctccctttctctatgtgttggcatcagatttttgtttttatttttcacacactgcctttatgtctcaatctttactatcaaagaggagctgcatctctttccttagttgcatgccaaaacattccagagaacagctgtgtattagtcaggattctcttagagggacagaactaataggaaatatatatatatatgtataaatatatatatgtatgtgtgtgtatgtgtatatatatatatatatatatatatatatatatatatatatatgagtttaagcaagcaaattaaagggggggttattaagtattaacttacccaatcacaaggtcccatgataggctacaagctgaggagcaaggagagccagtccgagtcccaaaagtgaagaacttggagtccgatgttcaagggcaggaagcatccaggacgggagaaagatgtaggctgggaggctcagcccatctctccttttcatgtttttctgtctgctttatattctctggaagctggttagattgtgcccaccagattgagggtggatctgccttccccagcccactgactcaaatgttaatctcctttggcaacacccacatagacacacccaggattaatattttgtatccctcagtccaatcaagttgacactcagtattaaccatcacaagctgggtcaagtgtgcacctctgagggcaggtggccagggccctcactagaaccatgtggctggagcggacagagaagcagatcccagcaagaaggactgagcagacacagccacaatgtccagcatggcactgcacaagatgccaaattctatgtatgaggtgggtcatggagctgggggagaaaaaaagaagagaaatagatcttgagagtaggggtggagtagggtcaggagaggggtcatcctgcagcataagcaagtgaattgaaaggacattcagttctgctcttgaacaaggatgcctcaggccatatacatttcttgccagtttcctctcaagcttaactaataacttttcctccttaaattctgtctgagctagttggcaaagtgaaataacattttctgtttatttgtgcttggtattgctggaaagattcctatgaagttgtggagtttttttttttcccctcatcattttgtttgtaaatttctactcaacataagccatttcttaataggctacctgggaactgtgacatgtactagtactggtcagtagtagctacatctttctacttggtggaatctgccttccagctatgaactctagctgtgagtctgatggaagctgatatggtttggcggtgtccccacccaaatctcatcttgaattgtagctcccataattcccatctgtcatgggagggacttggtgggaggtaactgaatcacgggggcagatctttcctgtgctgttctcatggtagtgaataagtctcatgagatctgatggttttatgaaggcagttcccctgcacatgctctttcttgcccgctgccatgtaagccgtgcctttgcttcttttttccttctgccatgatgaggcctccccagctgtgtggaactgtgagtctattaaagctctttccttaataaattacccagtcttagatgtgtctttattagcagtgtgagaacagactaatatagaagcatacttgcagttgaaggtggacagaacaacaggatcttagctttcccagaatgggtcaccagcctgacagtggtggtaacaaggacatgcagtggagatgatcaggactttggagccagaaagactaggatttagatccaggctgtaaaatgaataaggactgttatggaggatggggcacactgcccagatgccccttcttgatcatgatattcattgccccagctgttgagggtattgactggtgatggcttaaaactgaggcctttcctgggtgctgccgtggctgagggacctacctcacccaaggttacacacgtccccagagtgcctgagctgattcaaggactcaaaggctcaacagtctcatctcaggtcagggcaattctgaagttatcccagctctagagcttctgtgggacctgctgtgacctttgttgtgactgcacaggtgttcagcctctctctctgccccatcctgtttttgtttttgttttttacagtgttgttttagagagcattcccaataaacctcctacatgcaaatgttcatctcagcatctaagacaggtaaattctacatttaccttgtaggattttttctaccaggattaaagtcaatgtatgtattaagcaaatgctcattgtaatgctttaaaagccatgatctacatagttcagtcctagaattaagccagaattaaaatacagtatattcaaacagaataattccaaaataacttcagttctttacttatcctattaggagcaagactcttgcttgtaagttacaagaaagccaagtaagacttgtttaaggaaaacacaggcttatctacctatacatgtggttggtggggaccattcatgaacctatagggtccaggggtagactttcatgcacatctggatccaggggacattagctataggcagtcatctagaggctcaactagaacaccagcatatctgggtcttttccttctccatgcaatggcagcgcttcttcttccccttgtgctctgtcagcaggctagctagacttctggtatggtcactcgggactcctaaaagtgcaatagtcactgctgtgttatgatatgcagcttcctgttgtgtgccatgccatctcaatgtttggttcaaaaatcccagaatgtcactctaacacctcctgaattagggttgggttctcaagaaaaatccccgaatgtccctctaacaccttctgaattaggattcttaagagaaacaggaccaatagggtgtgtgtgtgtgtgtgtgtgtgttgcaaggaattggctcacatgattaggcaagctgaaaagtttcaagatctgcagtcagcaagctggagacccaggagagacaatgctgtagttccagtttgagcccaaaggcctgagatccaggagagtcaaattacgtaagttacaatttgaacatcagcaggcttgagacccaagagccagtgtttcagttcaagctcaacggcaggaaaagaccaatatcccagctggaacactcaggcagaaggagttccctcttacttggcctttttgttttagtcaggtcttcacatcttctattgattacatcaaatcatgggccagaacaactacacagaaaaccaatgaggaaatagcagacttgaactacactatcatctgttagatataacatacatctatagaacacttaacaacagcagaatatattattctcaagtatacatggaacattcttcaggataaatcattcactagatcgtaagacaaccctcaataagtgtaaaagaactgaaatcaaacaaagtacgttctccacagggcagccctgtgggactacacagaactacacaagagtgagaataccaggtgttcactggggctcatcattagggaccagctcccaaaggctacctggacaaaatctacttacagacaaaaagcaaacagttttgggcatgtcgctggctgctccctgaaactcctttggttttccatgttcaggctttggatcttggtaaatacaaaagttctttggaggactaacacaccaaacttgtatcagtcacttatatctttgtaaaaccaaagatcttcaatgatgtgataaaggaaggatatacatcaaagccctgggactcaagatgggaataaaggagctttactgaaagatgcgtggggcaggctggatggcaaaatcagattcagaaactgacctcactcacttttatagtttccatagtgctaggcctgcttaggtccttcataggtagtaatagccaagtttctctccttcggggcatctttaataggaatgtcagcccaagtccaaagccatgcagctacaatagcacaattttggacaggtaccaaaattgggaaggaatggggttgggggcattagagccttcctagagccaccaaaatcacaaactaactgcagtctgttgatagccttttaatggacatcaagatatacttactagagcaaaggttctgtccttttcccttaagatgatgcctctcttagggattggagagcaatcctaatttacaaatcagtttttggaaactggtttgtaaatattgacatcatagttagtttgacctcagtaacccaaagctaccaacaatggcagaagagccaaagggttcagcgtgattggccagtctgatcgtttttctctttgatttcagaaggcaatgattcctcaagtgtgcttggaatggaaattataaacaagtcattgctttcttcttatgtggaggtctgccatgtgagccgcatatttcaagtcttacctgcacctagcctttggcctgaaatgtgtcattgaatcaattaatgcttttaaatggctcactttactccatttttctgcatacattcagttacctaattctgttagcaaaggctattgatgggtctaagaaaaactgaaggccttcatctctggcaaagattcgtaatttgtgatgttggtggttactgcacccaaagtttccaacttaattgggaacagtgggaagtaatttagttgtgactgtttctctagctgttaatttagctgattttcattctattaaggctttaagggaaacaattccaaactaattagccagaacttccatttggtagtacagtagtcagttataggtaggacatgctgggtgtttcacttgtccaggcttcttatggtaaattctgcaagggtgcccaccctcagctctggatacatttggcatctagagacagatcttcgaaaatgctggtgtttataattaaaaccagagtctgttcggtgaccaaacactaaaactgcttgagttttgtttttctagctgaatttccaatgacaaaatatcacaggcgttttgtttattggctcttcccaggagaactgctgctaagataatatctaaagcttacaacattgtttaaaaagagaagtaagcattgtaacttctctttaaaaaagataaagcaaatactttccacttcattattttattaagactttagtgattttgaaaatctgatttttgtctgctaatgcttgtgaactaactgtggtttttctaagttttccacaggactgttcaagcagatgaggcacccccatgttctgagatctttacaaggcacagagaatggtccagctcacttagtcatcttccaaagccaggaagggggctcagcccagttctgcaggaacagacctaagcaccaatgatccctgcgtcaggtagttctagcagctgtctttccttcttgcacaggtaattctatgctacacagccccaaaacaaaagcttcctcagtggggtcatggtaaaaaagacttttttttttttaagacagagtcttgtgctgtctcccaggttggagtacagtggcaagatcttggctcactgcaacctccacctcctgggttcaagcaattctcctgcctcagcctcctgagtagctgggattagaggtgcccgccaccacacccagctaatttttgtatttttagttgagacagggtttcaccatgttggccaggttggtctcaaactcctgacctcaagtgacctgcccaccttggcttcccaaagtgctgggattacagccaatgtgcccagccccagaccgtcaattttaagctgcaaatttggtttggcaaatttggccaaaatgagagaaatctgattgcatttctcccacctgcaccatcagccactccctttgcagctgagtctggtaggtgcttctccttccctgccaaggacacactccactgcttcctaattgcctgagttttcagtggcagcttagatgttggccaggctttaatcagcctgggaaacagagtcctctgtcagcacatttgccactgaggcctgatgggaatgtgtgtgactacacagcaacaaaacggattcaccagccacatggggaaaccagcctcattacttcagagtcacgtcacgtggtctccttgggccagcaaccgctcttcttaattcctgctttcatcaggccatttgtcttaaactacatgcttgtctcatctcaaaattcattgtttagcttacatacagtggagacctgaggattaacacatcacggcactgaggggaaatgacttgttctcattcactcattattcagcaaccatttatgaatgtctgttcagccattagatagtctagattttccaagatagctctgtttaaggaaattttgaggctgggtgtggtggctcacgcctgtaatcctagcagtttgggaggcaaaggcgggcagattgccaggagttccagaccagcctaggtaacatggtgaaaccccgtttctactaaaacacaaaaaattagctgggcatggtggcgcatgcctgtaatcccagctactcaggaggctgaggcacaagaatcgtttggacccaggaggcagaggttgcagtgataatcaacctcagctatcacagctgagatagcgccactgcactctagcctgggcgacagagtgagactgtctccaaaaaataaaataaattttgatattttacataaaagcaatttattaactatacattaaatatgttcttaatacttgaggtgtagcatcacgattctgagaaaatgcttatcacaactgaatgacagaatccataaacagagccaaactgagtcttaagacaagaaatgcccttccaaaaatgtaaccttacaccttctctaggggagaagagttcctggtgaataaaaacacagggtccattctgtgatatgaaacaggactttgcaaagtgttttcacggatagctcatttctagtttttaaagctgccccttgtttggaaacaacagccacttcttgcagaaagaagacacatgtgactgtgtttatatctctgaagacagaggcaggattaaggtagtctgcaaaatctgactttttacaggaagaataactcttataaatacacaaaataggaaaacaaggggagaggttgcatgacgtgccccaaatttgcgatttgacttgctgtatattagtatctttgttaggagcaaagatggataagccgtaattcctgcttctaatgtgttcactgtagcaggggacaggaggtgtatataccaaccgttctaataggagttggaaagggacaagtgttacaaggaagaaaacacgggcactgccgagaaggacattaccttctgccggaaaggccacttagaggaagcatttcagccagtgttgaaggacccaaaagctttgcaatagcagagatgtgtggtcaggtgttgaaggcagacaaaatgtgtgagcaaaaatctgccaagaagggtaatagagtccaggtcgtgggaggacagtacagtgagatgaagagggagtgacaaattgatcaatacatctcaggttagcgaacctggacatcatttagcaagcagtgggggaagggtaaacctgaaagttattaaggttgggagtcgggggtggggcatgatcggagacgctaatacggaggtcttgagtagaattgggagagacgggagatacagggaggacaagaggaatgcaggggactgagaaggcagacgagaccttccacagtgtgcaggaaatggtcaggccccctgtgcaggaggaagaggactgttgatggaaacctgtggccacagaggcttctggcatctcacaaagcctttggtgtcagtctggcaaaacactctggccgggaacaagggatgctgggtgagtgagagcagtgcccctcaaaccttaatgtatgcacaaaccacttgaggattttgtaaaaatgtggattctgcatctgtaggtctgggtggggcctgagagagtgtacacattttcaacaacttccaggtgaagctcatgctgccggtccagggaccaccctttgagtagcaaggagctagaactactcacatttgctaattttaggcagtgatttataacagttggaagatctgtgagacagtgacccaattgcgtctaagtgttcttatttctttaaatctcactctaaatgtagcaggaagctggcacatgattaaacttgcatttgtttcttagattctaatttgactcatggaaactgcggtcctctccccaggagggtgtgtgtggacagcctttctgggtgtagaagttgtaagcaacccctcaggacaatctgcttccccatgtatgggggagtgggaggatgccaaaaaggggaaagagtcccagaagcctcccttctgtattagggggcctataggagcagcttcgggaccctgcagaagtcaaggaaggaagaatactcatccagaagtgatggatcctcgagcccatcctgactcagtgtttggagtcagtttgcagcctggaagaggctggggattacctcgaggtaatagtctatggtgggaggctgatgaccaaaatggcagcaggaaagcaggaatgtcacgtttggggcgggcacttgcaggctgatggcatctagagctgctcttcacagctccaaaaagtcctgccagcttgttccctgttactctatggggccctttatttctgggagaccagctgtatcttcacatcagccctcctggagcagaggcccctggcctttgtgtgagtcaagagggctggctttgagcttctcttggagctggataaggggtgtgcatgcccgtgaatgtattttgagttgtctacttataggataaccgtttgttcctcttcatcatcttaggccatatttctcttaatgatctacttggaccattttggggtcatcctattttcctctcctgggatggccatgccaggctgcttatttgcataatgtggccctggccccttctaacctcacttctgaggtcagatttccagctcgacccagtaagcctggaggaccaggcactgccctggacagtgaggctcaaggctcccgtgcagaacccatgcccaagcaatcatcaattattctaataattagaggtgtggtgtaacatgtgggggctctggacttaaacagcaagggttcaaatcctggctctgccaaatagttacatggcctgcttctcaaggacctgcactttggggccagcctaaccgggatctctattctgaatcctcgccttctccttgtgagaccttgggcaggtcacacgatcactcttgagcataggtttcctcggccataaagcagagatgatgacactctctccctcatagggttgtggtaagaattgagttatggaatgggtgggaagcatctcaaactgtgtgtggcgcaggggaagcacccaataaatagtagctattaccatgaaatgatacttagttaataagtaaggagttgtagttgtgggttttattagaaacaaagtaggtacgtctgcttcttagtccccatccctctgggaagccagaccacgagctcgtaaatgcttagcatggcgtccacctggtggccgcatccccaaatctctcatcaaaaacctggaggaaatgaaaaggcttgtaatttataaatcaaggcttctcatgggggccaggggaggagaggggagggcaagcacacactctggggccttggtaggggcctcacaggcagctcgaaaacaaagcggcactttgtcctggggcccggctttgctttttgtcataatatttaattaattttgaaatttcacataacattaaagtgtgagatatttacagctgctaaagaagggaacataggttaaaaaggttgagaaatcatctataacctataaaacacagcaaagcccccaggaatgtgataggtacagggaggcattgggctcagcacgttctgccccctctgcccagtgcccacctatccccagggtggcagggggtggtggagcccacgcagtccagcaagctgcctaattggaaaaagctggcacttctgtgttctggtcatttccttttgctttgtaatgcaaatgagtgaaacttgaaaaaatgttctttaaaaaccgtttgaaacatgatgcccagtcatccttgggttttcattattcttccacttatgccttaggatgtggggcatacatcctttattcaccctgagaagcccatttgccaccctggctaaatacaaccccttcataactcttttattcactcttttaatttttttataccacaggcttaataaaatttaaaaagtcaataaaagtgaaaaaatatacttgcaggagaatgcacaagtatatggctttttgaattgttgcaacgtgaatttgaccaatcacaaaacagaattaccaccgccacccccccagagggtgagcacagtcctggcttagaatggcacagaatcgctttgcttgattttgagctttatgttgtaaatggaatctcacaggatgtactgtgttgtacaggatgtatgatgttagggacacacatcatccatgttgctgggtgttgttatagacccttcattcttgttgtatagtgtccatggtgtggtcctccatggttggatatgtacccagtggaggtgcgcatgtgtcccctgacaggatcggtcccagggattggcatgtggcctaggtgggcccactgggatttcccaaattggaagggaaattggataggtatctctcctcctcatgagaaagggtatatcatagcagattggagtcaggccatctgtgtccaatcctggctgtgtcacttactaggtagtgggatctggtatgagttattacacctctctgtttcctgtgttaatttcctcttctgtaaaaggagataataacagcatctactccatagggtgatttcaaagattaaatgagtgcgtagaactgtgccaggcacgaattaagtgctgataagtggacttttattcctggatggtgaactgtgaaggtgtgaggctgggctgtggtggtcactgagctgcttgcagtaagaacgttgatttccctgaggttccctctgcaccctgttgtctgtcatgcctctaagcctttgcacatgctcttccctctgcccagcttatcagcttcccttttattcccacagaaaatttccattcctctttcctgtctcagctcaaagggatggaccagtcctgcaggcatccttcccacattctcccaagcaaatgctatccccatccctgctttcattgttgtgccacagcagttctcaaagtatgatctacaaaccccttttaaaataaaattttaaataaaaatttaaaaattaataaaagtaaaaaatatactgcagagaagtgaacaagtgtatggctttttgaattgttgcaaagtgaattcaaccaatcacaaagcagaacattaccactaccacccctgggagggtgagcacaaccctaagaggtgatttgccttgttcactgtgttgacatttgcactgatgatgcaaaaccattgctgaatgaatgtaacggcatttgcataaatcaagtggcacctggccgggtgcggtggctcacgcctgtaatcccagcactttgggaggccaaggtgggtggatcgcctgaagttaggatgtccggaatttattccttctggcgggttcttggtcttgctgacttcaagaatgaagccgcggaccctcgcagtgagcgttacagctcttaaaggtggtgtggacccaaagagtgagcagtagcaagatttattgtgaatagcgaaagaacaaagcttccacagcatggaaggggacccgagagggttgctgctgctggcttgggtggccagctttttttcccttatttggccccacccacgtcctgctaattggtccattttacagagtgctgattagtgtatttacagtcctttagctagacacagagtgctgattggtgggtttttacagagtgctaattagtgggtttacaatcctttagctagaaacagagcgctgattggtatgtttttacagagtgctgattggtgcttttacaatcctttagctagacagaaaagttctccaagtctccactcgacccaggaagtccagctggcttcacctctcattaggactttgagaccagcctggccaacatggcaagaccctgtctctactaaaaatacaaaacttagccgggcgaggtggcaggcatccataatcccagctacttaggaggctgaggcaggagaatcgcatgaacccgggaggcagaggttgcagtgagccaagattgtgccattgcactccagcctgggtgacagcattaagactctgtctcaaaaaaaaaaaaaaaaaaaaaaaaaaaaatcaaatggcaccaaactgtactactagtcattggactttcatcatcatgtactcattgtaaagaaaggaaaaagaaaagccagtttcgtttaagaatgtctttgatgaggcagtaaaaattgttaaattttgacccttgagtgcatgtacatgtatttttaaatattctgtgtaatggaataggaattatgcatgaaacatttccgtatactgaagtaggatggatgtctcaggtaaaaacacctgtgtgaatgagttacaagctgaattagctgccttttctgtgggacaccatttttacttgaaggaagaagtgacagactatagttattcagacttggatatctagcagagatttcctcaaaaatgaataaagagagcctgtcacatcaagaaaaataattgtcagtacttggtgccaaagatcaaagtagaactttcaaataccaattaaaattttagaaaatatataaatgccaccatgagtttaaaagtgtcctgtacttaaaaacttttctggtgagatacatggagatattcatgaatgggaccgagccagaatcttaccttgcactctttaaaataattaattaaggagacaaataataattgtatatatttatgggatacaatgtggttttgatatgtacatttctacattgcagaaagattaaattaacctaattaacacagccatcacctcacctgcttattcttttgtggtgagaatgtttaaaatctactcttttaacaattttgaaatatacaatatattattatggattatggtcacctcactgtgcaagatcagatcttattcttcctaactgaaactttgtatcctttgactaacatctcccctttcctcaaccctgcccagcctcactgcctctggtagctgccattctgtttctaacaacttgtttagactccacagataagtgagatcatttggcatttatctttttgtgcctggctcattttgcttagcataatggtctccaggtttatctatgttaccatgaatgacagaatttcctcctttttaaggccagatagtattctatcatgtgtatatataaattttctttatccatttatctgttgatagacaggttgttttcatatctttgctattgtgaatgatgctgaaatgagcatgaggatctatatatctctttgacatactgatttcaactcctttgggtatatacccagagtgagattgctggatcatatggtagttctatttttagcttcttaaggaaactccatactgttttccaaaatggctacaccagctggatgtggtagctcatgcctgtaaccccagctacttaggaggctgaggtgagaggattgcttgaggccaggggttcgaatctagcctgggcaacatagtgagacccccccatctctagaaatagatggatagatgaataaataaccaaaatggccatactaatttatattcctaccaacagtgtaccagggttcccttttctctacatcccggccaacacttacttttttctttttgataatagccatttaaacaggtgtaaggaaatattgtgattttaatttgcatttccctgatgattagagatgttgagcatttttcttgttgtttatctgttggccatttgtatatcttgttttgagaaatgtcgttctgatcctttgccattttaaagttggtttttaaattttcttactatttacttgtttgagttccttatacattttgtgggggttttgttttgttttatttttcttagagccaaggtctctgtcacccaggctggagtgcagtggtgtggtcatagctcactgcagccttgacctcctgggctcaagcaatcgtctcacatcagccttcctaatagctgggaccacagacacatgccaccacatgcagctgattttttttaaaactttttgtatagacagtcttgctatattgcccaggttggtcttgcactcttggcttcaagcaatcttcctgcctcagcctcccaaagttctaggattacaggtgtgagccactgcgcctaacccctgagttcctttttggatattagcctcttatcagatgtatggttgcaaatattttctccaaatccatgggttgtctcttcagtcttaattgtttccttcactgtgcagaggattttttagtttgatatctgtttgtctatttttgcttttgttgcctctgcttctgttatcatatccaagaaatcattacccagttttgttccactctttgtacataccttcccctctccaggttgtggcagtcctcctcctaataccaatgccataccatccacgatcttcctcccctctagttactattctgcacttcacccctcagacatactgtgccactgtgattgacagaagaattaacctggggaggagctgggctgacttccaggggagcagcccctggaccttagccttgggaggatgacacctgctgtttggtcagcccctttgcttgggggtccaggagggattttaattccagtagtgggaggttaaagccagcccatgggaagaggctagtgccttggaggctgacaggagagaatggtggggacaggctcccgttacaagcccttgtactcacatccttgcttctgcctagaagtccatgttggggccgggtgcagtggctcgcgcctgtaatcccagcactttgggaggccgaggcaggcggatcatgaggtcaggagatcaagaccatcctggccaacatggtgaaaccttgtctctactaaaaatacaaaaattagccgggcgcggtggcgtgtacctgtagtcccagctactcagtaggctgaggcagggagaattgcttgaaccagggaggtggaggttgcagtgagctgagatcgcgccattgcactccagcctggcaacagagcaagactccatcacaaaacaaatcaaatcaaaacaaaacaaagaagcccatgttgggaagcagttgtgaaagggggagggtaactggtgtattctcttccgcttttttaggagatgggcagggttattgtccagcatgtctttatttgaaactgcaagtaggaaggaaacttcagagtcaccaaaatctcacatctttagtctacagggaaaaagactctcttaaccttcagtaatcatagaaaagccttgatattaagtatttattggtaactaatattattctttggcaattattgtgaaataccttttaaaatcccttttgaagattatttttcttaagacatcaggatctctgatgtattattccttttttgttttaaactttttaacatattattttgaaatctgacactcaaaagaaggtgtgaaaatagtacagtgagtaatttcctttatgtttgtcaccgaactttccccagtgataatgtcttacatgatcatagcacattatccaaaccaggaaactggcattagtacaatactattaactaaactatagaccttatttgttctattgccacaaagaaactctcttgtgctacccctttgtagatgtgttccattagtcttttgtgtgtttgtgtgtgtgtgtgtgtgtgtgtgtgtatgtgtgtgtgtgtgtgacagagtctcactctgtcacccaggctggagtgcatggcacgatctcagctcactgcaacctctgcctcccaggttcaagcgattctcctgcctcagcctcccaagtagctggaattacaggcatgcaaaaccacgcccggctaatttttgtatttttagtagagacaaggtttcaccatgctggccaggttggtctggaactcctggcctcaagtgatccatctgcctctgcctcccaaagtgctgggattacaggtgtgagctaccacccccggcccattagtctttaaaatactgtttttccttatttgagtgaaagttatactttatataaagtatatgtgattagaatcaatggagtctagtgtagtgccatgcatgtagcaaattgtgtggaatttaaggctgaagaactagagaggccttctgcaaatattgacttgacagcccaggggctgtgtgattttaggcaaggaatgcaacctctctgagcttcagttttatctgtaaaacacagttaatgactcccactttgtagagatgctgagcagattagatatgaagcatatgaagatcctgggacgtcccaggtttcctgttcatgttcaatgtcttaagtcagtttgcccaggaagccgactctgagatggagaagtgtatgcaggtcatttgtttggaaagtgcttgcaggatcaacacctgtgagctgggaggtacacaggatttgacagagggagaagttgaactatgatgcagttgccatacaaggcctctgaagatgctccagggagctgggatggccctccaaaattgtccaggcctctgtaccccggcaccaaccagctgttgtattgtgggctgctcttggggagggacgaaatcttgagcaggtcagctcccttcagctgagcgcaagacctgaagacacagaactgtgagccttcggcatctaatgctcccggcagctggaggctgggcgtcttagtactgaacaggaatctgggagcgagtcacagctgctactgcagtcattattaccatgatggctttgaggaaggaggactcaaatggggagacaattgatcatagatttttcatcctccccacatgttagccatgttaaacccaggcaactgaatggcttgataactccacaaaaagctgtttctttttctgttttagggcattagaagggatctatttacatctttaggaagagctattttagaggagggggaaaaaaaagcaatgggtctcactcttctttatagctgctgatgggaatttcctaaatttctctttgccagctctataaaagaaccccatcgtgtgcaatcctcccctatataaggactgcctagaaatgagttctgaaatcagacttttaatgacttttcaagaaatcccttctcagactgccaaggacgagttggtatcagaaatatgcagtaattgtgtttatttagtaatagttggacgtctaccagaaggctctgagctaaggccactgggggataccaaagaagagaggctaatcctccaaccagaaggttccattttgtgccttctctcaatacatggccaatttgtgatagagtaaataagggaattttgaaagcaccaaattgagtacttagtagatgtatcatacctatggactgattatgatccttatggttcatatttaaatttgatttggtgtaatctataaacatcatgatgtcatgatcccttttctaagggaaagatcttacatgctagagtaaagcacatctcttctgtgcaacatcatgagttttggaatggaataagttttcatgagttttcctgatttgttagtctctctggagcaaattcctttagccagttattcaagcaactatgtgcctttatttgtttataagatacagtccacagcacatactaatagtgaaatgataacatccaagaattttcagccggccacagtggctcatgcctgtaattccagcactttgggaggctgcaacggaaggatcatttgaccaggagtttgaaaccagcctgggcaacatagcgaaacctcgtctctacaaaaaatttaaaaagtagctgggcattggggcacacacctacagtcccagctacttgggagactgaggcaggaggatcatttgagcccaggagtttgaggctgtactcagctatgatcatacaactgcacagtagcctaggtgacagagcaagaccctgtttctaagaaaaggggagggggtgcatttttctgccagaagggttgataaacactttttgtctttctctaacattcatgctgggtattatagggtagatgtcttcattagcacatagtgtcgtatctgtgacaaaggtataagacctcatgctgcaggtcactgtctacatctctccctctgtctgcctctctctctgtttctcagccagaggagagcccctgcaagatggaggaaggtgacattaccctggggggacttaagtggcacatgtcaccacttacttcctcactcaaggaaaagtctggggagcaggagcaagatctgttgtccctttgtaaccccacagggacttgcacaaatagagttggtgattaataactgttggaggctgaacagacttttctgtgaccccttattagcagtgccaggatgcgaagattgctcatcagccatggtgagcaccacaaattagtcatgtttggaggcagcaggtttctgatggttacatcagagatctgggctcattcctagaaacatcactgggcaattttcctttttaaatcagaatcgatggtgaacttatctactggatcagttaaaatgtcctggtctgagagtcagacaaggcctgagtttagaggcttgtgaagccacatgaccttagataagtggccaaaccacctaaaggtacacttttctcatcagttaagttggttgatactaacgttactgccctcataggcttgttttgtgagtcagatgagctaatacctgcaaagtgctgggctcacaacaaatgcttgataaatgttggctattattatcattattagggtaaccatatgttttctaaatcaagatactttgacagttaaggagggcagaaaaattagaatgttaacttttctaaaagatttatttcttgaccagtaaattggtttatattagtggacctataaaatagttctattcaaaaactattttcaaagataaaatactttcaaagaaaaaatagcaggaagtcctagccagagtaatcaggcaagagaaaggaaaaaaaggcatccaaataggaaaagaagaagataaattatctttcttcactgacaatatgatcctatatctagaaaaccctaaagactccaccaaaaggctcctagacctgataaatgatttcaataacgtttcaggatacaacgatgtacaaaaatcagctgcactttctatacacaaataatgttcaagctgagagccaaatcaagaacacagtcccacaaaaaagataaaatacctagaaatacatctaaccaaggaaatgaaagatctctacaaggagaactacaaaacactgctgaaagaaatcagagatgacacaaacaaatgtctaaatattccattctccctctccctctccctctccctctccctctccctctcccttttttttttctttttctttttttttttttttctttttttttttttttttttttttttttctttttcttttcttttttttttttttttttttttttttttcttctttttctttttttttttttttttttttctttttttttttttcttctttttttttttttttttttttcttttctttttttttttttttttttttcttttttttttttttttttttttttttttcttttttttttttctttttttttttttttttttttctcttctttttttttttttttttttttttctttttttttttcttctttctttttctctcttttttttttcttttttcttttttcttttttttttttttttttcttttttttttcttctttttttttttttctttttttttttttttttttttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactacaacctccacctcccagccgcctgccttggcctcccaaagtgccgagattgcagcctctgcccggccgccaccccgtctgggaagtgaggagtgtctctgcctggccgcccatcgtctgggatgtgaggagcccctctgcccggccgcccagtctgggaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccaccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcatctccgcccggcagccaccccatccgggagggaggtgagggggggtcagccccccgcccggccagctgccccatccgggagggaggtggggggtcagccccccgcccggccagccgtgccatccgggagggaggtgggggggtcagccccctgcccggccagccgcccggtccgggaggtgaggggcgcctctgcccggccgcccctactgggaagtgaggagcccctctgcccggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccggccagccgccccgtccgggagggaggtgggggtgtcggccccccgcccggccagccgccccgtccgggagggaggtggggggggtcagcccccctgcccggccagccgccccgtccgggaggtgaggggcgcctctgcccggccacccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggagggaggtggggggggtcagcccccctgcccggccagccgccccgtccgggaggtgaggggcgcctctgcccggccgcccctactgggaagtgaggagcccctctgcccggccagctgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcctggccagccgccccgtccgggagggaggtggggggtcagccccccgaccggccagccgccccgtccgggagggaggtgggggggtcagccccccgcccggccagccgccccgcccaggaagtgaggggcgcttctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaatattccatgctcatggataggaagaatcaatattgttaaaatggccatactgcccaaagcaatctacacattcaacactattcctatcaaactaccaatgtcacttttcacagaattagaaaaaaactaccacaaaattcatatggaaccaaaaaagaacctaaatagccaagataatcctaagcaaaaagaacaacgacagaggtatgacattacctgacttcaaactatgctatcagactacaagaaccaaaagagcatggtacttgtacgaaaacagacacatagaccaatggaacagattagagagcccagaaataaagctgcacacctataaccatctgatctttgacaaagttgacaaaaataagcaatgggaaaaggactccctatgtaacaaatgatgttgggataactagctagccatatgcagaagaatgaaactgaaccccaacttttcaccatacataaaaattaacttaaaatggattgatgatgtaaatgtaagacctcaaactataaaaactttagaagaaaacccaggaaatgccattctggacattggccttggcgaagaatttatgattaagtcctcaacaacaattgcaacagaaacaaaaattgataagaggaacctaattagatgaaagaggttttgtgcagccaaaggagccatcaacagcataaacagacaacccacagaattggagaaaatatttgccaactatgcatccaacaaaggtctaatatccagaatttataaggaacttaaagcaaaaaacaaccccattaaatagtgggcaaaggacatgaacagacacttctcaaaagaagacagacaagtggacaacaaacataaaaaagttcatcactaatcattagagaaatgcaaatcaaaaccacaatgagataccatctcacaccatcaaaatggctattattaaaaagacaaaaaacagggccaggtgtggtggctcatgcctgtaatgccagcactttgggaggccgaggtgggtgaatcacctgaggtcaggagttcaagaccagtctggccaacatggtgaaaccctgtctctactaaaaatacaaaaattagcctggcatggtggtacacgcctgtaattccagctactaaggagactgaggcaggagaatcgcttgaaccaaggaggcggaggttgtagtgagctgagattgcgtcactgcactccagcctgggtgacgagtgaaactccatctcaaaaaaaaaaaaaaaattaaaaattaaaaaaatagacaaaaaataacagatgctgacaaggctgctaggggaagaaaatgcttatacactgttggtgggaatgtaaattagttcaggcaccgtggaaagcagtttggagatttctcaaagaactaaaaacagaactaccattcaaccctgcaatcccattactgggcatatatccaaaggaaaataaatcattccacaaaaaagacacatatatgttaatcacagcactattcacagtagcaaagacatggaatcaatctatgtgcccatcaacagtgggtggataaagaaaatgtggtacctgtataccatggaatactacatagccagaaaaaaagaatgaaatcatgtcctttgcagcaacatagatgaatctggacaccatcatcctgagtgaattaatgcaggaatagacaatcaaattctgcatgttcccacttgtaagtgggagccaaatattgggtacatatggacataaagatgggaaaaatagacactggagacttttagaggggagagatggggaggggacaagggctaaagaactatcgggtactacactcactacatgggtgacaggagaatttgtgccccagacctcagtgtcacacagtatatccatgtaacaaaccttcacatgtaacccttaatctacaataaaagttgaaattattattagtattattattttttgagacagagtcttgctctgttgcccaggctggagtgcgatggcgccatctcggctcactgcagcctccgcctcccaggttcaagtgcgtctcctgcctcagcctcccaagtagctgggactacaggcgctcgccaccacgcccagctaatttttgtatttttagtagagacagggtttcactatgttggccaggctggtcttgaactcctgacctcaggtgatcctcctgcctctgcctcccagagtgctaggattacaggcatgagccaccatgcctggccaaaattattttttaaaaagaaaatggcatatatttgtgttcattaaagcaaatttgaaaacttatgttacctgaaaatttaaaaatttaaaataataactcgatatattttacatattttaatttcttggtctatctgtcatggtatttttctgcagagtgtattttttagtagttttactatttctaactttttttcataaaattatctgtatttggggcttaaaaactttgaaatgaatacttgcaattgattcttccttatatataaaaccacaatatatttaattgaaaaaatttctctgtagaagtgatggtgccttgtaagttgaaaactattctgctaagtaaagaccattctcaattctaatttttaaaaatattaaatgtgtgaccaagcacggtggctcacgcctataatcccagcaccttgggaggccaaggcgggcggatcacgaggtcaggagattgagaccatcctggctaacatggtgaaaccctgtctctactacaaatacaaaaaaattagctgggcgtggtggcgggcgcctgtagtcccagctactcaggaggctgaggcaggagaatggcatgaacctggaaggcggagtttgcagtgagctgagatagcgccactgcactccagcctgggcgacagagcaagactccgtctcaaaaaaaaaaaaacaaacaaacaaacaaacaaacaaacaaaaaaaattaaatgtgtgacgaatctagcttaaatattctcttaggtacttttgacctctattcagagagcctttcattgatacaacttgtcaaataggttgtctctatttacgattcttttgaatggttcaccaaatttaggtagttcaaaattgtaaaccttctcaattacattctattctgggacagaatctaaatccaaataaaaatagaggctccatcaaaatattcttctcacaagttgagatagtccagtgcacaattatagcatttccaaatttgtactttattagagctgtcattaacccccctcccctgctagctttgagggacacattccagtgtcttcctttgcagagctagcttgatgggcttatgaaccgcgcagtcacatggaacccagtgcttagaaggaccccgcaatgggtttcatgttctgctgccaccatcttgaaattcttaattttatttatttaggggacagagtatctctctgtcgcccaggctggagtacagtggcgtgatctcagctcactgcaacctctgcctcccaggtacaggtgattctcctgcctcagcctcccaagtagctgagactacaggtgcctaccacaacacctggctaatttttgtatttttagtagagacggagtttcaccatgttggccaggctggtctcaaactcctcacctcaactgatccaccctcctcggcctcccaaagggctgggattacagatgtgagccaccacaccagccaattcttaatttttgaccaagggatcctacaattgcaattttactctaggtcctgccaattatgtagctgattctgcctatttgtcaatttggttttcagtaattgtaattctctaaaactttcaagctcaaaagctgaaggtttaaaaagaacccatttgctcaatacattaattcccgtttagaaaaaaaaaaagtgcagcttgctgccagtgctcatttaattttacataaacacactctttgaggctaaagcaaatctgactgattttcaatgtgaaaataaaatataaaaactggttcttggagttacttctaaacagaactaacatcagaattgcctatctcggaaaaatcagattcatcaaatgactctttggccaataactgtttgagaacaatgttaacatcaggcataggagtgctacattttctaagatttgacattttcagtgatcgagaattacattttgtaaatggaaataccactactaaaattggatactgtaaataaaatgatatcttttgtttccaaagttgatatactcgagcagcgcgaaagtaataataaaagcaagatatttcgtggcaaagttatctcagggtaaacgctgcagctgcaagcgctgccggcaagtattctcggggcaaacggggaaagggttaaaaacttccaaattattttgaacaaaatgcaaccaaaattcggagcattgtagaacatttaggatgatttttataaagtagtttatcataaaggctttgctgtttctaagtcaatgggtaggcagcagggagaattttgtgatccgtgtgtgtgtgtataaaaatttgacaattcagctttcatttccattggcaggccactacagcttgtttgtacaatgtgctaattatacacattccactgcagtccaagtacatttctgctccacaggctcttgatttagtaagaatactgtttcccccaggattctggccactaaaacttattacctcaacagcaaactttctcttcagtgatgaaactttgaaactggatttatgatagcggtcaaaatgatgacagatttttttacccaaaggtaaaaacagaatgaactttccaacattttaattttatttaatacgttcattttttaaaagaactattattacaatggactgatttctcattggaagcagctgatgaccctgatataaactggtgtcaaacctgttagcatggctataattaaaaagttgagataatgtgtgttggtgagggtgtggaggaaagggaacccttgtacactgttggtgggaatataaattagtacagtcattactgaaaacagcatggaggttctgcaaaaaattaaaaataggactatcatatggcccagcaatccctctgccaggtatttatccaaagagatgaagtcaggccgggtgcaatggctcacgcctttaatcccagcactttgggaggccgaggcgggcagatcactggaggtcagaagttcaagaccagcctggccaatatggtgaaacccccgtctactaaaaatacaaaaattagccaggtgtggtggtgtacgcctgtaattccagctacttaggaggctgaggcaggagaatcgcttgaaccaaggagacggaggttgcagtgagctgagattgtgtcactggactccagcctgggtgacagagtaaaattccgtctcaaaaaaaaaaaaaaaaaagaaaaaaagaaaacaaaccaacaaaacacacaaataaccaaagaaatgaagtcaacacctcatcgagatatctgcgctcccttgttcattgcagcattattcacaatagccaagatatggaatcaacccaaatgtctatccaatggaggaatggataaagaaactgtggtatctgtatctctctatatagatcaatacaatgcaatattattcgactttaaaaaagaagatctttccactgatgacagcatggatgctaagtgaaataaggcagacacagaaagaaaaatgtgcatgatctcttttatacatggaatattttttaaaagttgactacatagaaacagtagattgacagttactagaggtgaagtgggtgcagggggtgcagaatggagagctgtagatcaaagggcacagagttgcagttatgtgttaataggatgaataaatctagagagtggaagtacatcataatgattgtagctaataatattgtactacatactggaaattttctatgagtagattttacatgctcttaccacagacacaaagaaggataactgtgagatgacagatacattaattgacttgactgtagtaatcacttcatatatcacttcaaaacattatgttacatatttataacataaatatattcaatcaaattgaaataaaactggtgtcatgtcactgtttacacagtactcattctgctaaaggagactcatttgcagctaatacttaatgtttcaggcatgcaccagaaaattgggagtggaaaatgaatgaaattattttagaacagttattgcatctatgtgaaaaattaagcttcgcagaataatataaaaacacacctcatgcagctgtgtgtgttataataatctttgggcatgatctacttaaggtaactactgacttttgaagtaaattctgatgcttcttcagaaaattcgcgttttctggttttcaggtgaccagtgttatcattatgacatcccagcagtggatgctagatatcaacaaatattttttgcaagttacacattcatctacaacctaatattttaatttttcactaaaaatgtgctttgaccttttcaagctgattgattgctgccaaggggtttattgcaaaagaaatgtatgttaccaaacaatgcaataaataaaggttgtagataaattataaagtaagtgacaaaaccactgtacacaagaacattcaaactacggtttctgtgctctgtgatgggctactcagcctccctttcctgcacatatttcacttcacctaaactatactttcgcacatttcccactgaccctgctgacatgtggccaggcagcttcatggacctcccaggctacagcaggcactagtgaaaggtggctggcagcagggtcagtacatctcccaacgccactgagtccctggaaacttgtaactggacacactgtaatttgtccagctgtctttcagagaccgtgttaattgcaccttatcagggaatggttgagaaaagagagaagggtattatagctggtcttccttagatttttatcaggagttacagtgagaactcagtttattgcacaggtctcatcactattgttcaagactgctggcaactgagaatgccaaggagagggctactaaacccatcccagcttgtcgaattccactgttttaatgtttttctaacaatgaagtgcccgatagacgtcaactgcctgggattgtcttgagaaaacctggatgtacagtcaccccaattgtgatccattgctctgcttatcctacaacttcctgatgaaacatcatcttgcactgattttacacacaacctctatgtactaaaaatgacctttcatttaaatgtaaaggaaagggtgaggctgcagttaaaaatgagacaatgtgaagctaaaagacagatggcaactcagtgggcgcgttcagatatcccagctaacctctcctggaagccaaatcccagggacaatttctggtcattttcttgctggagctattttcagttacagcaggctgaattctccaggggaagaggaaaactgggtaatttgtcttacttttccttcctaagtccagggcctacacaagtttgggcctacagcactgaaatcccctttgaactgtgccccgagtgaagtgtcaggaaaccgctgcttttttctggtgggggaaagggtgttgtaggtccaaagttgtattggagaccagctgtatacaagtcgtgtaaactttattgtctgaggacttcatcacctgtataaaggccctcacagtacggactgccaacacatctgggtcagaacagctgggaacaatttttagttggaaaaataacttacgtggaaaaggagcataaactttcatcatatattggctggttgtaaactaaggccatggcaagaaaaaatgcggatggcttgtttttctatttggttagagtcagctatttctggggcacatacggcacacagttcttaggtgacaggaccctgtcataaaatgaactggtcaccttattagcttttctgagtccttcactagtggattttggaaaacagatgctaaatgtttaacaaaatccacatacagtttattaaggcttttccacagttacccaatctacacaatatgccagtaggaaaaagcatttcaaagtaaacaaggatgaattaacacagattaaaattgtatatcttaatatcaaataatgccatgtggacttaggagaccagatgactgactggagatggccagacaggagaagatagcagagagggtcctgtccagaggcagaggaaaaccatattgtaaatttggaatcactgactgttttaatcatcagatagcttgctcttttcctggtggagaaagcaaaaagcatgaggcagcctcaatccacagagtgtctgagaaatagaactacccatggtacttggaaacttgaccttgtcaactccgaaagtgctgtttgcccaaaagccatataaatggttagtttttttaaaacttcacttgacctactattcaactattctttagatattttaatgtttctaatctaaagaattttttattgtggtaaaatatacataacatttaccatttttgccacttttaactgtacaactcactggcattaagcactttcatggtattgtttaaccatcaccattatctatttccataactcgatttctgatttttcgagcttctccaagatacaatatgtatgcccaaagagagaaagatgcacgattttgctgggatcaataagcaattgttggtttgcattcttctggctaggcatgtagactattacagagaccagctcttgttaggaatgcctgtatctgtcaacatattgtactttaccctcttttgaactttgcttttattctaggatgattgtaaaccagagaaaagcaacagaaatctataaatgccctaaaacatttcaacaggactatatgactggcatgggagctgtggggactttattatgttcatatttggaaaaagtcgtttaagccctgcaatgattagatgtgactgtgtgggttaattatgtaggagaagagatagtttcgttttaaatttctgcaattcaaactgtgtataaatatcatttaaaatgaagatccaaatcatcctggagaaaaactcactggccatcagagaaatgcaaatcaaaacaaaaatgagataccatctcacaccagttagaatggcaatcattaaaaagtcaggaaacaacaggtgctagagaggaagtggagaaataggaacacttttacacagttgtgggagtgtaaactagttcaaccattgtggaagacagtgtggcgattcctcaaggatctagaactagaaataccatttgacccaaccatcccattactgggtatatacccaaaggattataaatcatgctgctataaagacacatgcacacgtatgttaattgcggcactattcacaatagcaaagacttggaaccaacccaaatgtccgtcaatgatagactggattaagaaaatgtggcacatatacaccatggaatactatgcagccataaaaaaggatgagctcatgtcctttgtagggacacggatgaagccggaaaccatcattctgagcaaactatcgcaaggacaggaaatcaaacaccgcatgttctcactcaaaggtgggaattgaacaatgagaacacttggacacaggatggggaacatcacacaccagggcctgtcatggggtgggggaggggggaggggtagcattaggagaaatgcctaatgtaaatgacaagtttatgggtgcagcacaccaacatggcacatgtatacatatgtaacaaacctgcacgttgtgcccatgtaccctagaacttaaagtataaaaaaaaatgtggtaaagctttaggctgttccagttaccattgcaaacatgaaagaactcatagtggagaaaaactacaaatgtaagcaatatgggaaaatatttaattttcccagttttcctcaaagatatgaaagcaatcaaactggagaaagaaaacctataactgtaagaaacatgatttgaaaaagtgaaaggactcacactgaagaaaagccttacggtataagaaatgtggtcaggcatttagttcttttgtttgtttgattttgtttttttgaaacggagtctcgctctctcacccaggctggagtacagtggcacaatctcagctcactgcaacccctgcttcccgggttcaagcaattctcctgtctcagcctcccaagtagctgggactacaggcacatatcaccatgcctggataatttttatatttttattagagatggagtttcaccacattggtcaggctggtctcaaactcctgacctcagataatctacccgtctcagcctcccaaagtgctgggattacaggcatgagccaccacgcctggcccatttagttcttttagttgcatttgctgacttaaaatatctcattctggagagaagctctgtgaatgtatgagatgtgggaatgcctttgcttttcccatatcctttcatagacgcgtgatcatgcacacaagatggaccctataaacaggagaatcacacctgactggatcccgagtagtgtggaaaatacagaaaagttctcaattttaacaattactttcaaagtcatgtgaaaactcgtactggaaggaaatattgtaaataatattgaaagcctgttgcaaattcattattgtataatgcttgaaaaaaatttacaacatgaaagaaatgttatatgaattatatatatatattgtgtttatcagtggctcattattaaagaaggtctctggactatagatttccactgtttttgcgataaaagattgaggtgaaaattctgtaggtaccttttgagtgataattgtttaattaatctatgattaataggcctttgaaaaatgaatctttgttaattgtcaaaatttttcttactttatggggcaggttttggacagcctcacccattgtatatattccaactttttttttttttttttgagacggagtcttgctctgtcacccaagctggagggcagtggtgcaatttcagctcactgcaacctccacctcccaggttcaagtgatcctcctgcctcagcctccgaagtagctgggactacagacatgcaccaccatgcccggccaatttttgtgtatatatatacttttttttttttttttttaggagagacgaggtttcgccatgatggccaggctggtctcagactactgacctcagtgaaccacccgccttggcctcccaaagtgctgggattataggcgtgagccagtgtgcccggcctatattccaactttttattattatggaaaaaacttatcttttttgttataaaaaaaggttttttttttaataaagagttgatgtcagtttgtaaaatagtaaaaaatcaaaataaaaatgaagatcattgtaaaatgaaatgtcagaatatgcgtgcattgaacgaaatcaacaaaacacagacctgagtaactttagaattttaatctccatgaagctcaagatattcagatctaacaactttggtgcttacagaacatttatatcttctaactgtcccatgtgaatatcccacatagactctcaccagccatgacccaactccaggtagcaatgaaggcttgttgaagtcccatttggagcatttatggtctattcctggcccctactcttctattctgaaatcatggttgcaaaaggctcagaatttaaaggcttaattataaatgtctcttaaagagaaaaatggaaaggggactagtttaatggaacaattcattttatgagtcaaatagtgatatccatcattaattacatgtgatgcaaatatggccaaatgttagcacttgttaaatcattatggctactatatgggtattgtttttattattttctgcgctttctggacctaccattccaaaagtgaaaaaatgtaatttatagaattgacaaagcagagaacattttcctcctggggtaagcaaggaaaatttcaacattatattatttttggaattgactggacttcctactcctaagcaatcttacctgcacatcttttgaaatagacttaattgctgcctagagctcatagaaggatctcacagcactgctccagggcactgaagcttacagtgaaagcacattttcagcaagtactgaagattgtctccacgttggctggtttgaaactgtggtgagtgaattcagaaaataaatagtgttgattctttagagctttgaggctttgaagaaaataataacccttagtaattaacatgcctgtttgtttttagatcttttgaatgtaatccaggaaaggaatggaaaggaaagaagtgctcagaaagctcccagaagcattttggcactcaccaaagcagccggaagatgaataacacagtggggatagatggctaagtgggtcctatttatgtgttattcatcgacactagaaaacgtgctttaattcaaagcattgttttctcttcaagtgtctccagtcagcatcacgtagctttactaaatgcttttggtaatgctagagttatttcagcgtaccaagtgtctttgagtagtcccttaaggaaataaagctaagaaaagaagagggcagacagagggcattcgaccacaaagagtgagaatttcattggcttgtagaagaatccttcttggaaatggaatagtttatagcagagattcccaggcacacatgttcttaagaacaaaggggcctttggaatgctgtatcagtgaggatgcttttagttgcaagtaactgcagatccaactccagactggttaagccaagaggagatttattatcttgcgtaacaaatgcttaagtagccgtgcttcacccaaggcacactgggcttctggttccacttctctgtggcttctggatttgtcctcttctctttgtgggcttcatcctgcagcagctctgagcatcacatccactcacaacagagtcttgtggtctgtttggccccgccttgcctggacatgtgtatgttcattagggagtactgattcttctcaatgaggaggtgctggaaccagctgccagtgaggacagcagaggttgaaaagactgagaggtactagaaaagtaagaaaggaatgtataattgtgaataggttaaccccagctcttgaggaggacgtgcctaccttcagtcacctttttccgacatctgggataaaacaaaccagcaaatcaagtgagagcaataccgcactccacagtttactgctggcataaccccttaaaagaagaaacaaaatcttaagtgatcgtaaatgaaagaggtactctaagcagagacacatgttttccaagttaaggcaagagcaatagcattattgccttatatttgtttttgtttggttggttggttttattttttccttgacacaagttctcgctctgttgcccaggctggagtgcagtggaaccatctcgggtcactgcagccttgacttcctgggctcaagcaatcctcctgcctcagcctcccgaatagctgggatcacagtggggtcttgccatgttgcccaggctgatcttgaactcctggcctcaagcaatcctccagactctccaagtgctgggattataggtgtgggccactgtgcccagcctttttatttttattttttaagatacggggtttcattctgttgcccagactggagtggagtagcacaattacagctcacagcagtctccaactcttggcctcatgggatcctcccacttcagcctcctcagtagccagtattacaggcgcatgccatcatgccctacctttatatttgttaatataagcattatgacagcaggattttttttttcttattcactactggatctgcagtgattagaccaatgaataacacactgtatattctcaataaatatctgtcaaatgaatgagtcatggtgtgggcagtttaatagtttaaaaagacccagaaagagacagagagggatctgggttacagtgccaactatatcatttactagctgtagaatcttttttgttgttgtttgtttgtttgtttgttttgagacagggtctcactcttgtcgcccaggctggagtgcagtggtgtgatctcagctcattgcaacctcgacctcccagactcaggtgattcttccacctcagcctcccaggtagctgggactacaggcatgcaccaccacgcttggctaattttctgtattattattatttttttagagatggggttttgccacattgcccaggctgatcttggactccttggctaaagtgatcaacctgcctcagcctcccaaattgttgcgatttacaggcatgagccaccaagcccagcctgtagaatcctttctgtgcctcaatttcctcttctgtaaaatggggataatagaaacctgcttcatcgggttgttgtgagaattaaatgaatcaatacatgtaaagtgcttagaacagtgccaagcccatagtaagccctcaggaattgttgactgttcattatcactgctaccacttactaagtttttgacttctataagcctgagtttcctcacttgtaaaatgggaataataaaaggtacctcattttgaggatgaaatgagacattgtttattctttcctcacaacatcaggcacgcgattaggaacaacttggccaaaggtcactataattccttatctatctcagtgctttttatttacaaacttatttttattcccataatatattgattcccacaaaaacttaatgagagaacaggtcaactatatgccccttttacaggtggagaaactaacacatggagcagctaaaagcctgttaagactcactttatagacagatagtagagccagaagtcaacacagcagccacccgatgcttctcattgcagatcttccacattctaacacaatttttaagcagagacttcatagctggagagtgactttattgagcaaacgtacaatattggctcagaaatggaggacttataaaaactgtttctaggtgggatagtgtctggaatttgtgggttcttggtctcactgacttcaagaataaagctgcggaccctcgtggtgagtgttacagttcttaaagatagtgtatccggagtatgttccttctgatgttcagacgtgttcggagtttcttccttctggtgggttcgtggtctcactggcttcaggagtgaagctgcagacctttgcggtgagtgttacagctcctaaggcggcgcgtctggagttgctcgttcctcctgtccggagttgttcgttcctcccggtgggttcgtggtctcggtggcctcaagagtgaagctgcagaccttcacggtgagtgtcacatctcataaagacagtgtggacccaaagagtgagcagcagcaagatttattgcaaagagcgaaagaacaaagcttccacgttgtggaaggggacccaagcaggttgccactgctagctcgggcagcctgcttttattcccttatctgaccccacccacatcctgctgattggcccattttacagagagccgattagtccgttttgacagggtgctgattggtgtgtttacaatccctgaggtagacacagagtgctgatgggtgtatttacaatcctctagctagaggtaaaagttctctaagtccccactagattagctagacacagagcactgattggtgcatttacaaaccttgagatagacacagggtgctgattggtgcgtttacaaaccttgagctagacacagagtgctgattggtgcctttacaatcctttagctagacataaaagttctccaagtccccaccccacccaggagcccagctggcttcccctagtggatgctgcgccggggcaatgggtggagctgcctgccagtcccacacagtgcacccgcactcctcagtccttgggcggttgatgggaccaggcgcggtggagcacggggcggcgcctgtcggggaggctcgggccatgcaggaacccactgcaggggggcttgggcatggcgggctgcaggtcccgagccctgccccgcaggaaggcgtctgaggcccagcaagaatttgagcgtggcgcgggccggccagcagtgctgggggacctggcgcaccctccgcagctgctggcccgggtgctaagctcctcactgcctggggccagcggcaccggccggctgcttcaagtgcgggcccactgagcccgcgcccatccagaactcgcactggccagtgagtgctgcacgcagccctggttcccgcctgtgcctctccctctacccctctctgcaagcagagggagccggctccagcctcggccagcccagagagggtctcccacagtgcagcagcaggctgaagggctcctcaagcatggccagagtggatgccgaggccgaggaggtgctgagagtgagtgaggcctgctagcacgttgtcacctctcaggatgatgtaggggaaggagggaggaagtgaccaggacaggaaataacatttcacaagaagtgctcttaagggaggaaggttagaatgatccatgtggtattggattagagttagagacatcagaatgaactcacgaatttagcttaatatagctacagatggttacaaatagatatttgcagatatgtatcgattcatggattagtatgtatagatacatacattttattgctctgtcagctaaaagggcctagaaaccacaacaccccaatagtaatgagcacccctagcacccagatcttggtttctaataccattctctagtaaaagaaaccaggaatcactggagaaatggctgattctagggctgcactaataacatacaaaaggaaactatagtgccagaaagtaaggaagtgctggggtaaaaagataggggtatgtcaaagggatgcaagagccaactgaaaaggttaccaatggccaaagcttgaacaacttgagcaataaagtaaataatgtagtattggctgataacccaaagtataaaataaatgttaatccacctaacagaaatacatgattgtatgaataaataaatgggggagaagagataaatctcccttgcagaagaattccaaataatttatgtagatactcccccatcaaggaggtggaagatattcttaccccttaagtgggggctgcatataatgacttctttccaaagagtccaggatggaaagaagggagaaaagagtaactttacagtggagaagtctgataaaccctacctcaatcagaagatcaagttaatatcaatagtgataagtcaacttgatagttaggtacccttcaggtgatgccatgagaatggtactttatctcagtggtcttccttccaaaaacccataacccctatctagccatgagaaaaatgccagacaaactcaaagtgaagaatattctataaaatgcctgacacctgaccagtatttctcaaaactattaaggtcatcaaaaataaggaaattctgagaaactgtcacagccaggaggagcttaagtagacatgacaactaaatgtaacattgtatcctggatgaaatcctggggcagaagagagatgtttggttaaaactaaagaaatttgaattaactaaggactgtaattaagaagacatcaatattttttagttttgataaatatgccatatgaatgtgagatgttaataagagaaaccaagaatggaatattcaggaactttctgtactatattttcttttctgtaaatctaaaactattctaaaatttaaagtttgtcaaaaattaattgggctgctagggcagcaacaacaacaataaaaaagacatggaaaacaaaaagcaaatgagaaaatagaaaacaaacagcaaaatgatgaatgtatgctcaaccatataaatatgttcattgtaagtggtctaaacactgcaattaaaagccagatattgtcagagaattttaaaaatacaatatccaggctggatgtggtggctcatgcctgtaatcccagcactttgggaggccaaggcgggcagatcacttgaggtcaggagtttgagaccagcctggccaacatggtaaaaccccgtctctactaaaaatacaaaaattagctgggtgtggtaggacatgtgcctgtaatcttagctaccccaggaggctgaagaaggagaatctcttgaacctgggaggtggaggctgcagtgagccaagatctcaccattgcactctagcctgggtgacagagcaagactccatctcaaaaaaaaaaaaaaaaaaaacaaacaaaaaaaacaatattcagtgtatgctgtctatacaagaaaccactttaaatataaagatacagatagattaaaataaaagatggagatacatataccaatcaagcaataatcaagagaaagctggagtagatacaaagtagagttcataacaaggaatatgatcatagataaagaggacatttcataataaaggcgttatttcattaagaagacaacagttctaatgtgtatgtacttaataatggagctttgaaatatacacaacaaaaactgatagaactgaaaggagaatagagtaagagttttcgttggagatttcaatactcttctctcagtaatgatagaacaagtagaaaagagaaaataagaatacaaagtaagtgaagataaagacttgaacaaattcccacccagaacatcagaataaattgcacgtcttttacatagcacattgatggctgtcactttttaatccagtctaaaaatctatactttctaatttcagtgtttaatctcttacatttgattgatgtaatttctggtggtgtgagtttatgaatcatgttgctttgttttccatgtgttctttctttctttgttccttcttgactgccttctcttagattattttcacattctttttatcttctttattgcttcttacctatgtctctttgggtttttttttttaaataatgatggctctagtgatttcaatatgcaaccttaatttatcattgtctacactgaataaatattatagtacttcatggacagaataatgacttaaaacactataattccatttacagcctttatccctttgtgctattttgttatgtgtttcacttctacgtatgttacaaaccccacaacacttgctattatttttatctaaacactcaaacatcttttcaaaattaaaaaaataaaaactagtcttttatatttacccacatatttaccttttttagtgcttttcattccttcctgtagattccttctgaaatctggcttccatctgggataacttccctttagctgaaaaaaactctagagattttagtgatataaacatataaacaaaatggcccatttcttgtagtttgggtctgttggtaacacattctctgagctttttttttttttttccattaaaagtgtctttatttccccctcattctgaagtttattttcacaggatgtagaattctaggttgataattgttatgtatttttaaaacacttggccaggcacggtggctcacgcttgtaatcctagcactttgggaagcccaggcggatggattgcctgagctcaggagattgagaccagcctgagcaacatggtgaaactcgtctctactaaaatacaaaaaaaaaaaaaaaaattagccggcatggcagtgtgtgcctgtagtcccagctactcaggaggctgaggtgggagaattgcttgaacccaggaggcagaagttgcagtggctgagattgtgccactgtactccagcctggtgacagagtgagactccgtctcaaaaaataaaaacaaacaaacaaaaaaaccatttcaatgatatggttttactctattctgaattctattatttctgataaaaagtcagttgtcatccatgtctctcctcccacattccaaaccccctctttctcccaaatataaagtgtatttttttctttgacttttttttttttttttttttggagacagggccacagttctgtcccaggttagaatgcagtgagttttgtttttgccacaactcactgcagcctcgacctcccaggctcaagtaatcctcttgcctcagcctcctgagtagctaagaccacacaccaccatgcctggctaattttttattttttgtagagacgaggtatcattatattgcccaggatggtctcaaactcctggacacaagcaatctgctcaacttaccctcccaaaatgctaggattatatacctttcaacatttattttatccaattttctttgtccttgctttctgagactccaattctatgtatattagactatttgatattgtccccccaaattaatatttttatttttaatctttttcttctctgtgcttctgttaagataatttctattcacttgtctttaaattttccaatgctttatccccctgtgtccagtattcttaggaatttagttcacatatcctccttttcattgttcactggctttaaaaagtagacagacagacagatatttttcccttggcttgagtaacagtcttttacaactgtctacattttaattggaaatagaaccttgagtgggtcttaagcagtcttatatcatacaaagaacatgctaaaaatgtagtatttctgggaaatactatcagacatcagacaatatctaggatattaaaaaaaaattccttaggtggttctaatgcaggagtccccacacacccttaaagaaacactaatttgttgttagaagctgaagtcaaaataaaagttagcagtcaaatgcaaatgagtttcaattgaggcctcaggaagaccatcaacaaagctatcagattgctttactaaattcaactttcgaaaactcatagccattatgaaaaccagtgtggaggttcctcaaaaaattaaaaatgtaactaccatatgatccagattagtaccttcacctatgagcagacttctgggtatatgtccagaggaactgaaatcagcatcttacagagatatctaacccatcatgttcatggccgcattattcacaatagccaagatatggaatcatcccaagtgtccactgatggatgagtaaataaagaaaatgtagtataggcacacagtggaatactattcagcctttgaaaagaaggaagtcctgtcatctgtgactacacggattaacctggaagatattatgctaagtaaaataagccaggcacagaaagataaatactgcacgatctcatttatatgtggaatctacaaaagtcaaactcatagaggcagagagtagaatggtggttgctaggggctggggagtggtggggtggtagagtgggggtggggagatgttggtcaaagggtacaaagtttcaattagacagaataaataagttttggagatttattgtataccatggtgactatagttaatgataatgttttgtatacttgaaaattgctaagagaatagatcttaaatgttccaaccacaaaaaaaggataagtatgtgaggtgacagatatgttattagcttgatataatcatttcacaatgtatatgtaagaacatcaggttgcacaccataaacatatacaatatttatttgtcaattataccttaataaagctggtggagggacaacttaatttaaataaactggtaaatatggaaacagacatggcctgtaatttccaaaagccatgtagttactccatttcatttgttcttgattttatgctgggctgtagctcctcagtgaaccaactaaagtcataattagacagttttaggagacaagaacgtcttcagtgatgtgtataggcaggcttgcataactctttgaaagatctccaaagaggaatatgaatgattgagaacacatagatctgctatttaccaattaatcctaaggttccatggcctggaacaattaccaagagctaaagacattaacttggatattgtgtggctatcaagaaaggactctaatttttgaacaaatataccagaaattatgcactcaaatgagtgcagttctcttcaacaggcaaaaagaaattgagtatcaaccctgcttcattggtttcactccctagagagttgcattggggattttaaggtagaatatagctcagcgggaaagagtcatctatgagcatggtctgccatgaacatggctagggtccatggcaacagaagtggtacataattgcccttcctgggttaatggtaagagcctcgggtttgaagccttgagcataaatttggctctgccatctactaactgtgagatcttgtgaaaacacattctctgagtctcaatttattttatttaatggtaattggtcacaaaaaatttccactttctatttcataggtatacatgtgatatcccctttgaaacttaacagtgcactaatagcaagttgttcttcaaggaagtcactttggtaggctatgatcttatttacaacaattctgtcattgcacattctttgggagtgcatttataaacagtttgagcaatttgggagaagcacttttacatgtccctgtgatggctaattttatgtgtcaatttggctatggtaagggatacccagaaaatgaaaaaaaaattatttctgggtgtatctggaagggtattttcagaagatattagcatttgaattagtagactgagtaaagaagattacctctcatcagtgtgggcaggtatcagcaaatccatcaagggcccaaatagaataaaaaggcagaggggggcgaattctctctctttttcttgagctagatgtccatcttctcctgcccttggacattagagctcctggctcttgtgcctttggattctaggacttataccggagccctcttgcctccaactgggagatacaccattggctcccgtagttctcaggcctttggatttggactgaaccatgggaattggctcacaaagttatggaggccaggaagtcccatgatatgccatttgcaaactggagaaccagcatcatgggacttcttggcttccataattgtgtgaaccaattcccatagtacatctcctcttatgtatccataattattctatttgttctgtttctccagggaatcctgactaatacacggtgttttgataattcagctagatcacctacaaatcgatcaggaactttggattcaaatgatatcattgttgccaaaaatcgaattcactattagtggatgaagatttgttaccactgggttattaaaaagcgtaggccacaggcttttgaagattcttcccaaagaggaattccaaaaatgatttatgcaattgcagcctcattagtgtaagagtatggtctcccaagggagctatgttgaaggctgaaactcacttgaatatgtaatcttctgttagcttgtttaattaatcggtcattttgcgttagaatctcatggatgtatagcagagttaccatgctttgaatgagaatgatggtcacacactgatcctgcagtaatctctaagaatataaacaaggtagcccagatgaactctcaccctctgatagagagggaattggagctttctggcgcttactgataacataacaagaatatcttcagtgatgtgtataggcaggcctgtataactctttggaagacctccaaagaggaatatgaatgataagtctccaagcaaacaactatttgtaaccccagaattataaaatatagatgtaatacggttgtgaaaatcctttctgtttgggccaggcacagtggcttatgcctgtgaatcactttgggaggccaaggtgggaggattgtttgagcccaggagttcaagaccagcctgggcaacatagtgagatcctgtctttacaaaaaaattaaaaattagccagttgtggtagcacatgcctgtggtcccagctgtttggaaggctgagatggaggactgcttgagcccaggaggttgaaactgcagtgagccatatctacaccacagtactccagccacttcagctttgaggacagagcgagaccctgtctcaagaaataaaaaaaaaataggaatgaaaaaagaaaatcctgtttgttcaaaagtaactactatggttaggcaaaggcaggaaatgttagaagaaatgcagcgagaagtccttggaaggagtatattttagcattggagtctgggctacgtgaaggagatgttgacacagatccaatcctaaactgttagggagggtgcagtatctctctgagactgtgtcatgagggatctctgcccttttcctgagctttagagggtcatactctagactttttctctctatgagaagaggagtccacgggctaaagggttgtgccccccttaagcccactgtggtagaaggaattctaagatggcacccaagattcacgcactctctatcttccccctctttgagtgtgagtgtgacctatgaatcacactccatgattaggtgacattatatggcaaaagtggagggatttgcagatataattatcgtttctcatcagttaactataagtcaacaaaaaaagattgtcctggatggaccttacttagtaaggtgaaatcctttaaaagagggctgaacccttcatgaaaagagagaatctgctggtcttgaagaatcaagttgccattagttctatagccacaaggaaatgaattctgccaatgaccatttgagcttgaaagaggactctgaacctcagatgaaactgcagccctggttgacaccttgactgcagtccagtgagaccctgagcagaggaaccagttaagccacactcagactcttgacccaaggaaatcatgagataatggacatgtgttgttgtaaggcattaagttggtggtgacttgagatgcagcatggaacaggaattcacccatgcctcatcttctagtctaatggcacgcaaagtttgatctgtttactgctggtccaggatgagctaagtatagaaagtgagagtaagtggtactttttatggcaatttaacactgctgaaatatttaaattatattttacaaaaatgtggatccacagtagagtgaactttttaaaaaaagcatttttcaccagataagtactgttctagttcatgatctgccttcttagaattctgaattctctgcccacctgaccctgaaagaggaatgaattagctcttcaagggcctgctcagtcctctttctttggtctgcctgtataagggcagacagtgctgctgctgaactaacccctagccctgacagttggccaagaaacagctctttatgggggttgaagatggagcttcagatgtgtgggttggcaggttcacacatgactataagcacctggaagtgctggatagaaagatgggaagagaagagaggaataaccaggggccagaagctatgaatggctgttcatatgtaacctcaaaattccctgctaaaacatgggaaatcccaaatttttaagttcaaatacagctttcgggtcattgtgaaggtctattggccaaagtagaaggaaagaacatattttatttaatattatgctagcttggcttatgtttttaaacattctagacatatgctatgccggccttcatttgttctcctgtactggccttgtaaatatgttaagagtgggcctggagagtggtctcttctggaacacttccatctacttctcccagagattgcaaacctagaatctggagctgctgaagtggaagggttttgttcttttttgttgttgtttttagtgatgcctcatcataattaacacaaaaaggttttctgcactaatgatgcttagatttttttaacccatttttctctaactgcatgatggtaggtgctatggtttgaatgcctcccaaaatctgcatgttggaaacttaatactcaggcagcattgttgggagttggggcctaatgagaggtgattaggccataagggggaagtaaatggattaaaacccatttatgcctagtgttccattattggaacactaagcatgtaggagttatttatatctactgctcaaggtctgattggcaaaaattcaaaaaattgcaacctcaggcagaaatggtttaatactgttatcatggaaatgggtttgttataaaagggtgtgtctggcccccttttatctctctctcttttgcccttccaccttgggatggcacagcaagaagcccctctccggatgccggcccctcttggacttcccagcttccagaattgtgagccagtcaatttctgttcattataaattacccagtctcaggtattctgttatagcagcacaaaacagactaagacagtgggttatcctaaatccatactatgccagcgagaaccaaggggtgtagcatgtttcctgagcagtgtttcagatccccagcagaaggtaaatgctgtaaattactgtgcatttgccacagtgtagtagactgaatagtggccaccaaagatatccaggtcctaatccctaacacctgtgaatactaatgtaatgtgtcaaaacaggctttgtagatgtgattaagtcaaggaattttcgatggagagagtatcctagattaacttggtgggacctaaatgcaatcacaaatgaccttataagagagaggcagagggagacttgacaccatataaagaaatgggacattaaggcaagaggctgaggtattggctttgaagatggaggaaggggccacaagccaaggaatgcaaagagtacatctctagaagctcaaaagataagaaaaaggattctccccaaaagcctccagaaggagtgcaaccctaccgatgccatgatcttgggctaatgtaactgattttacattctgacccccagaactattggagaataaaagtgtgttatttgaagccactaagtttgtggtaatttgtcacagcaggtaaagtaaactaatatacacagcaaacaatgagaatatttttaaaatctgaattaaaagtctgggattttggtgtgtgtgcaaccactaccagttttctagatactcttctagagacaaggtattgtgaaacagacaatataagtgagaatggaagagagtaacacagacccaaagggcatgcttcaaaagccacaggggaggccagatcccagctgacacaccactttagaataagagtgtttcctcaaaataactgaaggaacaccgagaagggctatagatgtgttcagctttattcccacagttgacatttataatgtatcagtccctccctgttaatagcttgactgacagacaatcaaaggatgtgtgggactcataaatagtccgaagcacacccaagagggagcatttgtaatgcagccttcagagactaggtagaaaggaaaggaagggagcaaaggaaaactcagggaggaatttaagggacaagtgttcctgaccaaaatgtcagagcctggactaagctcttgatcacaaagaaatggtgagaagccccgtagctgaaattactgtgagagcccgttggagtcagaggaagtatttgtggtgggattacagggaaacttttctacttcttgtctccacataagccccaggttagtcccaaaggactgtggatgctgttgaggcttagtgaacacccagtaatgggagaagaagagactcgctttcagtaccatattcccttgggtacagagaaaaagctcaggccgttttgaaaacagctgctgcacttttcccaaatgacctttctttgttcccttcagctccaagcccttggactcattctccatttttctctttatgcaggtgtatgtttaagctcaggctggaaaaggatcactgaaagtcacttggatggtgtctcgtgtgtctgtgatgagcttgctgttgctttctttctccttgacaggtgggtttatttcttatggaatcagaccttttggctacagtgttctctaaacagctgtaataccatctcactcagttaacctaactttggatctgatgtacatcagaataaaacctatagagaatagagctgacttccccaaatccatgtgcctccactaacccccaaggagcttagtgtggctggttgtgaatgacagtgatctccgtgatgagaagtaatccctcctctagaaatactttacctgttttctttggtgcttaacaccctctgcatgagacattgctctatgggctttcatctcccctgtgacaaaggacacatctttctcatttccacattccctcctcttgcttctcccccatgccacctcccctttgtccctctaccaacacataggtacctgcgtcagttaggcacctactctacagcccatggaacaaataaagctttcaaacattagttatttaatcaatgggtcaaaaaaaaacagtatctgaatatgcgcagcatctaacctttttgatgggcttttgaatctagtgcctcattttgtctcttcaacatccctctgaactcagtataacaagtagtaatagccccattgaacatataaaaaaacctgacatctgggaaagttttaacttaggaaaaggtcacattgcagattattggcagagttcacattagaatctgtttcttactctgttgtcctcaccactatactatggtgctttcgttcattgagttgacctatggtaaagttataagccttgctgtttttgcaagtggggagactgggacttgggcatctgaattttgacctggaggttaatggtgtcaataggaatgtaactgcatgcagtctcttagatggatggatggtaagaaaacctttactttctatataactccagaagacaattctgtcattttaaactacaaatatcaactatggtttttttgggaggaatatttattatttaattttaaaaaattatttttgatacaaagtcttgtgctgttgcccaggctggagtgcagtggcgccatcttgacttatgtagtctcttcctcccaggctcaagcaatcctcctgcctcagcctcctgagtagctgggactacaggtgtgcaccaccacaccggactaatttttatattttctgtagaggcgggtttcaccatgttgcccaggctggtctcaaactcttgggctcaagcaatcctcccgcctctgcctccaagtgttgggattgcaggtgtgagccactgcacccagccaattttttttttaagtttcttgtgggtaccctgtaggtgtatatatttgtggagtacatgagatgttttgatacaggtctgcagtgtgtaataatcacatcatggagactggggtatcccttctctcaatcacctcccttttgttttactatttatttatttttaaatgaactcttatttatgtgagatgactttgttaagggtgaggacagggacagatacttgcttccttttctgccatgtcactgccagtccatattagagcccactctggaggctaatgaatttttcttctctctgtgtcccgtcagccccagtcccctctgcccattggacccactcttcccaggaccccgggttcacagctaatgcctttcagtcagaggcaggagtagattatttagtttcttcccagagaaactccccacagcccaaaccacatttatcctgcaaatattaaccacttttcatagcagtgcatccatgagttattatgctaacagctgcctctgcttcattgtgcaaaagatattttcccagcaaagggtggggacgcagggcagaggagggtgagaagggaggaaaatcccaccctgtcacgctcgtttaaagttatcatgtgccgcccgccccccattcattcaacacacatttaccttctggcagcaactgcgttatgagatataaatatgaatagaatgcaatgctctacctaagggaattcatggctaagaaaaagaaatagacacaaataggtttgttgtaaagcgaagtggaattagagcaggtccagcaaagaaaggcagcagggacaagggacaggcattccaggcagcaggacagggtgagccgaggcatggaggtgggaaacagctcactgtgtgtgtcgtatctctccaggcaaagctccctgaaagaggaaagagccagggaagtgacaagcagagcccagaggggcttgcaagccatgttaaggagcttaggggtggggtgggaactgaagggtttcaagcaggggaacaatggcagatgcgcagttgcgtggatggtagatgggaggatggatcagattagggcaaaactgaaagcagggaccagtcacaagaggaacttcattccagggagagatgttgagggtctgaactgaggcagtgcagtgggaagagaaggatgaattagaaaacagttgcagagggacttgggaggtcatgggagctagatggggatgagggctgagggagaagtagcagtctggaggggtctttgagtaaggctggaacccctctctagaactctctgcccagtgcccagagaacctcacaggagataagaagatggacacacagagttgatggctgctcaagacattgtcccctcccctacaatcccccgttcaaagctggtgaggagtatggccaagcagtctgaccccaggactgtggtcctcagcagggcgagggtggggaggatttcgaaagtgggagaccagagtgaagcaagaggctgtcagcggaaggactggaagggccaggcccacgtggtcacgtgtttgcagctttagctaattcatcctcccaacgtctctatgagggtgacacagttattgccccattttacaggggagaaaattgaggctcagcaggtaatctgtggccaagttacagaccacagtgctggcatgtggagggcatttcctccagctcagcataactggcatgggagaaagactggcttcaccacagcaagccccacagggccatcagagtggaccagggaatagtgcagccggggagacctaagcagaacttccagtgacaaggagaggattctctggaggcagctgggaggggcccatgagacgcctttgggcattcacaaaaggtgtgagggctttggggtcccagcagatttcctcagggtggggtagggtagaggtagggaaagaggctgaaaaagatcatgattttgttgcaattttattaaccatctttcttagtttttacctgcatttatatgcaggctaacagcccctgaaagagttcataaactcagcctctgaatctgtcccatcatccccacaagcatcctgggaaagagagtcttttcattttctctgtctctgtctctctctcaacagatgagaaaacagtggcttcaaaggttaaacaacttgtcttcgattgcacagctaacaagaggtaaaactggaatttgaatcgtggtactgtgacttcagaggccaggttcgtagcgctacactaacacagagaccagaagaagccttgacattatcataaaaccacagacatgatacaaggccaggaagaaggaggcttgggagcttattagctgaaatatattgatcaccttttcacagctttctcttattatcctcccaatgtctctgtgaggacagtacagttatcaccccattctagagatgaggaaactgaagctcagaggtgttaagaaacttgttctaggtcacacagctagtaatgcttgggatcaggatttgaatttagatttgtcatattccaaagtttacctatagtctcagctactagggaggctaaggcaggagaattgcttgagcccaggagtttgatttcagattgagcaacatagtaagatcccatgtcaaaaaagaaaaataaacaggtgaaattaattttaacaatatgctttacctaacccaatatatgcaaaatattacattttaacatgtaatcaatattttcaaagttaataatgaataccagaaataacacatgtgctaataacatgtacgctgcaacactaatatcttacctgatacaacagttaaaatcaagtcccaccagagcaataaagttgtgtctaccagaaaaatattttacactgcttccatttttaaatttacatttaaattaattgacattaagtaacatttaaaactcagttcctcagtcacacgggctacattttaagtgtgcaacaaccacatatggctagtggccacagtggtgctggttaatgagcacagctctaagccttccttgtgtgtttttttaaaaattcaattcagattccacttccattgtttgcttgtttaaccttaaaatctgtgtgttttaacagacctgtgtttaagccttataagtcccatcacaaagtgtcagtggtttggagagaggttctagaacgttctctttgtaacattatcacaaatctgtggttgttaggctgctcttggtttatgtttgagttaaaccctttgtgtggtgtcagaccaattcaggcttatgttttccccggagagaggaataagctgctattttggaccctgtcgtgatccctgcccagagtcaaaagtaattcccaagcagactgatttttacagggtcatgctcctctgatcttctctccaggagtgtgattttcaacgggatagagaaaggcaaactcctgaggaaaaatttctctgggaaagcccaggctgaagtcgaggagggaagaggacgaaaggctgacagggttgccgtctctgagggagatccactcacacacctcaggaggcattgtgggatggtcaaagtggggaggaagaaagggaatcttcgaaagaaacttgcggcggggcacggtggctcacgcctgtaatcccagcactttgggaggctgagatgagtggatcacaaggtcaggagttcgagaccagcctggtctggccaacatggtgaaaccctgtctctactaaaaatacaaaaattggccgggctcggtggctcacgcctgtaatgccagcgctttgggaggccgaggcaggtggatcccctgaggtcaggagttcaagaccagcctgaccaacatggagaagccccgtctctactaaaaatacaaaaaaaaaaaaaaaaaaaattagccaggcatgatggcacacacctgtaatcccggctacttgggaggctgaggcaggagaattgcttgagcccgggaggcagaggttgcggtgagccgagatttcaccattgcactccggcctgggcaacaagagcaaaactctgtctcaacaacaacaacaaaaaattatccgggcgtggtggcatgcacctgtaatcctagctacttaagatgctgaggcaggataattgcttgaacccggtaggcagaggttgcagtgagcagaaatcgcaccactgcaccccagcttgggtgacagagcaagactctgtctcggaaaaaaaaagaaaaaaagaaagaaacttaggctgaaaggtttaaatggacacagaacagcaaactcaaggacttccatagctactgggaaccagcacagggctgacacctccattgaactctctttgctattctagaatattttaataatgagacacacccaaaacatgtttagaatcatgccacctgctgcttctcatggccagcattatttgtcatcaaatctgatcccaatgtttgccatattattggatatcctgtgaaatagaatctaaaaatatacattttttccctctaaatcggtcctaaccttacagctagggttgcaactgtaatattgttgtctgtttcattttactttccaggattaggtaataatattaaattccccatctcatgttagtttctgtttgaacttggcctggtatttgaagaatatatttagaagttaaagcgtgctactttttatcccatgcaagccagttgtgggttcatagatctgtggtatctcataacattttctgtcctaaactgaacacatccagtctctccaaattgaagttcctcagctgaggttattttcatttcggagaatttcttgagagttgtttctgttatagaggataaagggatagaggagtcacagctgcctaaagtcagtgcctctttaaatacaggccttccttgcctccaggacttgatgtcttcctttagtggagggcagctcctcaattgaagagggcgggattgagggagcagttgaagcagcaggttcgcctgggctcatgcttttctcttgtgtggctgctgttacagggaccttcaggcacgttctaggaaagccaattaaagcagaaaaggcccttagaaccaaattgattgcccccagtatagctgttaaactttgagagagcagctgggtgcttcttgtggccctgatagtgccagattgttcatgctgccttaggctttcctgtaacatttttgaaaacccttgttatatccagtttaatgacatgtattgatcagaacaaaaagggctgaggtactgactccaggatcaactcacagacagaaccatacatttctattttttagattctgcaaagcacccaagtcaaacataggattattcccagggtcatgaccatacagcattttatctgtgaagaacagatagtttaagtcctttatttccatttgatttcaaatgtggataaagaaacaactaatttattttcagaaatgtacatcacctctgactctcaaattagcacctgattttcttattttcactttgaaaccgctgtgtgctattttgattctctagaaagagttaaacttctcataggcattaaacccaagtggaaatagttggcccaaggcctaaacttgttctttatgagaaatacaagactcgaagggattctagcctttttagaattatcatagaatgtgtacaggaagcatgacattggcagaaagggaacataggtgccttttaccgtgtttatatggacatgggttctgggttttacagatggggaaatattgtacgagtccatggggatatgtagtgaaatggagagggagagggagaaagaaagagagagagagagagagagagagagagagaaagagatattcttttgtactttcagactgagcagtttacccaagtcagagaagcaagggtatacaggtaaagtacagaatagtctggaataatgtcattattgtttggtctctttacttctttatagggcatctcagagagagaacacagtttctcaaagtggatggaaggtgtattataagtttttaacccagaataaccaaaacaatcttgaaaatgaacaaaattgaagattcatacttcctgatttcaaaacttactacaaagcttaagtaaacaaggcagtgtagtgctggcagagactaggcatagagactaatggagcagaattgagattccaaaaataaacccatacatctatggtaattgattttcaactagaatatcaagcccattcaataggttaagaatgtttcttttcaacaattggtgctggtacaactgcttatccacaggcaaacaaatgaatctggaaccctacctcacaccatatacaagaattagaatggatcaaaagacccaagtgtaaaagctaaaagtgtaaaacccttagaagcaaacaggtatatatctttgcgaccttggatttagcaattttgtttttgtttttgttttgagacagaatcttgctctgtcacccaggctggagtgcagtggtgtgatgtgggctccctgcaacctctgcctcccgggttcaagcgattttcctgcctcagtctcctgagtggctgggaccacaggtgtgggccaccacacccagccaatttttttatttttagtcaagatggagtttcaccatgttggacatgctggtcttgagctcctgacctcaagtaatctgcctgcctcagcctcccaaagtgctgggattacaggcgtgagcgactgcacctggctggcaatggttttttagttatgatgttgaaagcacaagcaactaaaaaaagagagaaaaatcagatttcatcaaaattaaacatttttgtgtgtcaaaagagactatcaagaaagtaaaaaaacaacctacagaatgggagaaaatatatgcaaatcttatattgggtaagggtctagtatctaaaatatatgaaggactcttactattcaacaataaagagacaaatagctcaacttaaaagtggtcaaaacatgtgaatagacacttctctaatatacgaatggccaatacacacatgaaaagatgctctacataattagccgtcagggaagtaaaaatcaaaaccacattagataccacttcacactcactaggatgctataataaatttcttttaaatggaaaataacaagcgttggcatggctgtggagactggaaccttcatacattgttagagggaatataaaattgtgcagccactttggaaaacagtttccagtacctctacaagttaaacacaaagttaccatatgacccagctccactcctaggtatatacccaggagaattgaaggcatatgtttatacaaaaacatacatgaatggtcatagcggcattattaataataacccaaaagcaaaaacaacccaattgtccatcaactgatgattgataaacacaatgtgacatattcatactagacaattaaataaaagaaaactttttttttttttgagacaggatccggatctctctctgtcacccaggctgcagtgcagtggcatggtcttggcttgttgcagccttggcctcccggactgaagctatccttccacctccctcgcagagcccgcttcccccaccaatagctgggattatcagcgtgcaccaccacatacagctaattttagtattttttatagagacagagtttccccatcttgcccaggcccacctgtctcatcctcccaaagtgctgggattacagacgtgcgcctctgcacccagcccagaaaacttcttacacattagcacccactccctattcaccgctccccacagcccttggcaaccacgaatctattttctgtctctatggatttgccaattctggacatttcatataaatagaatcatacagtatgtggccttgtgtgtgtgtgtgcgagtgtgtttgtgtgtatgtctggcttctttccttagcatactgttttcaaggttcacacatgttgtagttatgtaccaatcctttattcccttttattgccaaataatactacattgtctaaagcaagtctaacttaaaggaaaaaaaaaaaaatatatatatatatatatatatatatatatatatatatatatatatatatttcattgtatgattataccacattttgttcatccattcatcaattgatagacatttttgggttatttccacattttgggctcttatgaagaatgctgatataagccttcataaacaaatttttgtgtggtctgtggtcatgttttcacttctcttgggtttttgtatatattttaaatgctgtaaaaactttcctgacttagataataatgattcctttattgacaagtataaagctttctcatcaaaagatagaaaactgactccattttgtatcacagtatcacatccttagaacattgagagctcaaaaagaactcagacacctgctgggtgagaccctgattctattgacaaggcctagagaggtggggtgaccactacaggtaagacagccagtgaatgacagagacagacacagaaccatggtctcccaacctacatccccttcccatctagatggacatcatctttaaccccgtgactcttacccagagtgaaccatcggtctttccagagtctgggaggggaatgtttccatggtgaagatgacttcccagagtgggaccttagggggtagtagacatcccctacctcccccaaaccattccccttctccataacttgctacagtacttgcagtttcaccagcagccaatccactggttgaatggagggctcacaaatgaatggcctatgggggccagagaggaatgaaacagagtggattgggcaggctggcaagctggaaagcacatgccccccccacgaaatagcttaggacaaaagccacaggatctgtgttcgtgaaacatcttggaggcttggggttgagcaagtggcttcttagcccagcgtgcaagatttggcatgtgggccatgctagcctccctgtagcgctggcattctgaaatctcagagatgctgctacagaggaaagccaggcattgcagggcaaggctctcacagtggccgccagcacctcatggtggcacgaaacttgagcaggagaggaagggtgggcttgttcctgagcaccagaagctgcaactaccctggcacccttttgttaactggggagaacctttgaggagatgctggtgaacgttccatgcaggggctgagaaccatcacaatttggcccataatactgcaaacaaagtccagcaagcctaggaaatttaggattcatctctaaaacagtattctctgtttagaagcatatagaatattttataatccaaatgagttgattgcctcttggcttgcgttagcgagatgctatcattgcaataagcggaaatctcaactctgttagcttaggcaaaccatacaactcattggggattcagattgctgttccttggtcttgctgtttgccttgctacatgcgtatgaatgtgcagatgacaagaacagatgccagggcccctggaagatcaaagtcctggcgctgccttagaaaatctgtccatgccacatccctaaatctgcaggaaggccatagtaaatatgcaatagatatttgttccattgaatgaactctaaagcaaacccattcttaaccattcctatgtaagaccaaagcacatgtgcaggcggctgggaccaaaaacaaggagtagtacttttggggacacaattgtcactgctgtttccccactatcttagcattcggccacttctccaatatccagattaatttgctgcaatgaaaatttcctctcttttgtattaaaactaccctaacattattttcatggttatttttccaaaactggaaataagaacacattgtttctagattgtggacagtggttccagagaagggaaaaccagaagggttttatgactcaggaagaaagagctcccagaggggcccaggtggtttttcttccatcctcccctttacgatactctgaatatctttttttttttttttttgagacacagtcttgctctgtcacccagactggagcgcagtggcactatctctgcttactgcagcctctgcctcttaggtttaagcgattctcctacctcagactcccaagaagctgggattaaaggcacccaccaccactcccggctaatttttgtatttttagtggagacaggagttcaccatgttggccaggctggtctcaaactcctgacttcaagtgatccgcccacctcaccctcccaaagtgatgggattataggtgtgagccactgcgcctggcctgaatatctttttaaaaattattttggaaggttttctgacttgcccttcaacatttctagccttccctttctgtccccaacattaatctcccgcaagtctcttctccattgcttctccgcgttggcaggcccatatttttgtgtggcttctctctcctgtttactcaaaagctcataattacttttctcttgtggataaaaataagcagaatgccagtagtatgatttttaaaaagagaagcttcccagatgcctactcctgaccgcatggaatcattctgatgagagcatgcttaatcaatcgaccctgcattgtctgcaaggcttggttcaactggctgactccattatcctgtaaactgtgcaattttctctaaagacatttcaccagcacaactgcataaaacaaatgttgaatgggaaaaaaatcagtagtagatattttttaagacatcctaacaccattaaggtttttttccgctgcaacctgcatctggtagtaaaatctttcttttccagacattgttttctccaaagaatcattcaaaaagttactaccgtatgaaaactctttagccatttacattttgtgggttttaacaagcgtgtcttccaggctgactctggctggtagaggttttcacccattcctcaatgggcaccagaattctgatgagttcatgacattcagtttaagaaattacccgcggccaaagatcttgattggcaaggttagtacattttgccatatgttatgtgctatctctgtccccaaatatgcaactcttatggtgtgacaaattgtgggacgacacacgttgcagcccagacagttagacaaaacactccatcagaactgaaaccgcaggctaggtctctgaataagaaatatgcaaaaccacacctgccggccaacattgctgcttatttcttgctcctcttttttttcttaccacaaagaaaattaaatgtaaaatcaatttaatgttgagaaaaggacccagggtgagcttcccacgtacacttaattgagtcagtgatattttgtgtggcctagttatagcttgagtggtgcagctgagtgtaagctgtttgtgatttggagtttaaatcctatgtttaattattgccagtatcacataggatacagtggctgacaacgcaacagagttagacttaacagttgtctgtggtttgggcctggttatctgtttaagatcaatatattctaacaaaaattcttgccatggttaaatcctcatgtgttctgctattaggactcaatatttatgatacttgagggcaggaatttcttcataatggaaagtgatattattgggagtggtagagattcatttttgaaatccattctgacatggaaacgtcttaaggtcattgaatttcaaaaacttgtcttttaagggatagttttcttctgataatataacgagatgagaatgttgtgctgtcttgagtaaaatgtgtggtatttgtgtctgttgggtattaatgtgtattatgtgcattggaatcatgggtgccttctatattttaagtaatgagaaaaggtccacaattttataagctgtgtgtatgtgtgtgtgtgtgtgtgtgtgtgtgtgtgtgatctgtctatcatctatctatctatctatctatctatctatctatctatctatctatcatctatctatctttatttatatatagtaaagtatatatacaactttgccactgggagcactgtaagtttctataaccacttgcagtttaagaattgtgccaaattggccaggcatggtggctcatgcctgtaatcccagcactttcggaggccgaggcaggcagatcacctgaggtcaggagttcaagaccaggctggtcaacatgttatggtgagacccccgtctctactacaaatacaaaaatcagctgggcatggtggcacatgcctataatcccaattacttgggaggctgaggcaggataatttttttttttttttgaacggagtctcactctgtcacccaggctggagtgcagtggcgtgatctcggctcactgcaagctccacctcccaggttcacaccattctcctgcctcagcctcccaagtagctaggactacaggcacccgccaccacgcctggctaattttttgtatttttagtagagacggggtttcattgtgttagccaggatggtctcgatctcctgacctcgtgatccacccacctcagccttccaaagtactgggattacaggcgtgagccactgtgcctggccaggagaattgtttgaacgtgggaggcggaggttgcagtgagccgagatcgtgccactgcactccagcctgggcaacagagtgagactctgtctcaaaaaaaaaaaaaaaaaaaaaaaaagaattgtgtcaaatcaaaggccagttctttggaggttttgtagatctgcagcaccaagtaggtgcttgacacatattttcaggagttcttttgtcatcactgaatcaaatgcaaccttagtttttccagcccattctgtcagcctagtcccaggttcccttttgcagtgtcctctcaggtgtggccattcagtgcctgtcatccaagtccatttttggatccttgagtcatttttcttctaatctctcaaactccatattcaactcatcagtaaattctttctctggtatctcaaaagcattttcaattaactctgtaactcaactctacgcccttaattttcagtacagatgctcctcggtttatgatggtgttttctcctgatacacccatcacaaattgaaaatatcttaagttgaaaatgctttcgatacctctaacctactgaacatcataggttagcttagcccaccttacattaatctatagttgggcaaagtcatctaatacaaagcctattttataataaggtgtcaaatatctcatgtaatttattgaatactgtactgaaagtgaaaaacagaatggttgtatgggtacttgaagtacggtttctactgaatatgtattgcttttgcaccaccatagagttgaaaaattgcaagtcgacctattgtaagttggagattgcctgcactgccatctctcatctggaaactacagtagcctccaaaatatgcttcctgcttcccctctggtccctcactgatccttgatcacagagcagctggaatgatcatcaaaacgcatccatcagatcatctgacttttcttctcaaaactttggatggcttcccacatctcttacaagacatcctaaattccttaggatggcaacatcttattccctgcttcctgtgtctctcttcaaccttatctcataatctcactttccccctttcttgctcaccacatctctgatcctggttcctttcggttctgggaacaagtcaaactctttccagtctcagggcctttgcacctgttgatatctctgacccaaagtgttacatagccccacccttgttgcatgtaggttttggcacaaatgtcacctcctcagagaggtttttcctcaccattttgttttattttatttatattttttgagacagagtttcactcttgttgcccaggctggagtgcaatggtgccatcttggctcattgcaatctctgccacccaggttcaagcgattctcctgcctcagcctcccgagaagctgggattacagacatgcaccaccacacccagctaatgtttgtatttttagtagagatagggtttcaccatgttggccaggctggtcttgaactccggacctcaggtgatctgcccacctcggcctcccaaagtgctgggattacaggtgtgagccacctcacccagtcatccctcgccattttaaaagtagacacttcctgctattctctattcattccctattctttccttcctggtttctgctaccatctgtgattatgttgcttatttacttgtttattgtttgttttcccccataatactgtaaatctcatgaaagtaggaaccctatctatcatgcaccctcagtgcctagtgcagtgtttggcacaaaggaagtgctcaataaatttgttgaatgaatgaacaaacagaaaatcctttcaaatactgaggaaaaaaaatctgcttacttaaaatttctacagttggttctaattctgtttctactattgtttccaattctaaggcaacatgcaataattctgcagcttcatatacatgatcacatttcagatctttgatacccttttattttttgagacagagttttgctcttgttgcccagactggagtgcgatggtgtgatcttggctcacctcactgcaacctccacctcccaggttcaagcaattctcctgcctcagcctcccaagtagctgggattataggcacccaccaccacgcccagctaatttttttgtaattttagtagagatggggtttcaccatgttggccaggctggtttcgaactcctgacctcaggtgatccacacgcctcggcctctcaatgtgctgggattacaggtgtgagccaccatgtgtggccagatctttgatacccttcttaggcatcttacatctgtgctatttatactgctcaaccttcctttgtatggcatggtttctgactttctcatggcagtaatcactctctgttggaagactctagtttgacaacatccttcactaacaacaacaacaacaacaaaaaaataaaaatagaaaagccagcgtggtggctcatgcctgtaatcccagcactttgggaggccgaggtgggcggatcacgaggtcaggagattgagaccatcctggctaacacggtgaaaccccgtctctactaaaaatacaaaaaaattagccgggtgtggtggtacgcgcctgtagtcccagctattcaggaggctgaggcaggagaatggcataaacccgagaggcggagcttgcagtgagctgagatagcgccactacactccaacctgggtgacagagcgagactccgtctcacaaaaaaaaaaaaaaaaaaaaaaaagtgttctgaccgctgcaaggtctaatagcactcattctccttgattagaatcccatcagatttatggtctgtagttttcagaatctattgtttttggtttttttttttccgcaacgtatattgcaaaacagaacattccccaaggtttctggcgttttccccactctccatgatttctcaaacttaccgctagtggttctgtgattctatctgcaaatttcttttgtactctggaatataatttgtttggacccagaagatttaaaatcttgcctaaattttatatattttattttaaaatatacctagatttttccttgttctctaacttactgtaggctccagttttcccttttcatcatctactttgctgcacagttagaaatcagaatccattctcctcgctccagaagatggaatttgagtatttggtagtttgtactttttgtcacctgttaacatttcaccatcttcttggaccttcacttccttcttcatcttctcttccttatcctcttccttcttcttcccttctttaatctttcatcttttgttctctcctccttccctccctccctccttccttccctccctctccttcttaccttccctccttccttctttccttcttctctcctttctccttctttcctttcctccttcctccctcccttcctccttccctcctgctctacttccttccctctctctctctttcctttccttctttccctccttccttctttccttctttccttcctccctccctccctcccccttccctccttccttccttccctcccttccttccttccttctttccttcctccctccctccctcccccttacctccctgccttccttccggcgggcgtacttgcgggcgggcggggctgcgggggggcgtgggtagggggggggggtggggggggggcgggggggggggggggggggggggggggggggggggggggggggggggggggggggggggggggggggggggggggggggggagggaggggggggtgagagggggggggggggggggggggggggggggggggggggggggggggggggagggggggggggggggggggggggggggggggggggggggagggggggggggggggggggggggggggggggaggggggggggggaggggggggggggggggggggggggggggggggggggggggggggggggggggggggggggggggggggggagggggggggggggggggggggggcgggggcggggggggggagggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggagtaacaagaacttaacaaaacacaatagataaataaaaaaaaaaattataccaacatttataaaaaccctataaagcaaaatataaaagagaaaatataaaaaaaataaggaccacaaataagtacaaataaggaaacaataatcgcccaaaaaaccaaaaaaaagtatttgaatagagatagtagtcccaataagaggaaaacaacacaaaaaaataacaattataaaaaacctaataaagaagaaaagaaaacaacagaaaaaataagaaagtataataaaagtgttcacaaatatgggaaacactacaaatagagaccaattaggagcgaaataaataataaagaatataataagaggagatttataaaccaaatgaagaaaaaaatgaggataaaaaaataagaacataatataaaataccacaaaaattttaaaaagagacatttattaaacggaaaaaaagtataatcaattaaaaaataaacatagaaaattcaaaaaagagagaaaagacaataatagtgaaacaaagagagaagaacatatataaggagtaaaattaatcatgaaaaattaaaacaagattaggataaaaaagattaatatataaaaaaagaattacgagttaagaattggagaaataaccaaaggaattatccaaaaaaataaaaatatgtagaagtaagcaccaaggaaaggaaaaagataaaataatgaaaaaaatgaaatattaaaaaaaaataaaaaagagaaataaaacctgtaaatccctgcttcctcccttccttccttctctcccaccccattctctctgaactgaatctatcatggaacacctttttaatctcacttgtttctgagatttcccactagctaaggctttagtcttcctaaaagccttctctcttctttttttttttttgttttgatcttggatatgggtcccttattattgcttgtgaacatgtctttaaaaaaaaaacaaaacatgagttcatgagagttttctgagtggccacactggcttataagtttacttatcctttccctatttacaggattgttcattattccattgccttggaatttatgtaatgctctctttctttgctattatggactcccaaaagacatggtcacattctcccaaggtctctataatttccatatagaaaccagttctttctctttggttaaaattgcatgcagaataccagtttctcctttgatctgagagctgaaattgttagctaggaaagtctcaaaatttttataggctgctctactttagcaaaatatgacctccaacagacataaagatagttcaagttcctatccctatgactgcttgcttgtagttatgtggtctgctttcaggaaggctcctccatgcctgggcacccaacctaagccctcgccctcgaaggaatcctgtttatgttttgcccgtaattcccggctgcttccgttcttactgagtaactttctgtacagaaacgggctatctttttgcatcctcttttcacatataaggctgcttcttcctgcctctctcaaaacaatgactctttctattgctgtatttcaggtaggagtcccatcacatctatgtgagaatggctgtgcttcttatattaacataagttaatttctttctttgcatctcatcctctgtgactcagtgtcagagatattttcgtgtttaagggatttttttttttgatgagtttctctcagttttaacaaaaactgacatatgagtaccatctacaagactccagcagtttccccggtatcccattcttctcatgtttgactctcattctccctcatcccctgagaagatttttccctctaattttctagtgttccatccctttaaaattctctcttggctggatacgttggctcacgcctgtaatccgagtactttgggaggccgaggcgggtggatcacgaggtcaggagttcaagacccgcctggccagcatggtgaaaccctatctctactaaaaatacaaaaaattagcagggcgtggtggcgggtgcctgtaatcccagctactcaggaggctgaggcagagaattgcttgaacccaggaagcagagtttgcagtgaaccgagatcacgccactgcactccagcctgggcgacagagcgagactccatctcaaaaagaaaaagtcttccttaaatttttttttttttttcgagacagagtctcactctgtcacccaggctggagtacagcggtgcgatctcggctcactgcaacctccacctcccaggttcaagtgattctcctgcctcagcctcccaactagctgggattacaggcatgcgccaccacacctggctaatttttgtattgtttttagtagagacagggtttcaccatgtgggccaggctggactcaaactcctgacctcaggtgaaccacccgccctaggcctcccagattgctgggattacaggcgtgagccaccacacctggcccaaattttttcactgagcaaatactcttgtgtatggaaaggcatttctcttggactttgcctgctcctctgctagctgatcatcacagtaactggtggtcaccccaggaaccgggggtgttacagatatagaagataccccgcacaaaccggcaggaaaatgatttctaaatctcaatttagctgaccatgtgattctgatgaagaaccatatgagaagcatagatacaggaacacaacttgtagaagtggccccatgcagactgcaaagcaatgccctttgtggtacaaaattaagtgtctcctttttctttggattaggggaaggggctgtgagcaagggagaaggcggttcttggaagcaggtgggattggaagagggagagggggctttggggaggggagaggtctgcaggatttggccttcccttcccttctttccatcagacaaaccattctgcccctttagctcccctgagactaggaggaagccccttgccattgttctctatcactgcctcttttcttcctgcaggattgtgtcccacctaaacaatccccatttcctgcactgcctgccctggtggcttcttccaggacctcagggaagcaggcagcttcatctccaagtctcccaggcctgtggcctcaccccaccactcccaccctcacctcctttgtcaccccaggagttctctctggcattcatgcctgccccaccttgccccagacactgtacctgaggatgcagatctgggaggttgcatgtactcctgggctgtagtttaaggcttattcaaaggcctgtttgtaggcagtatggtataagcagtcgaaactagataaaggcagatttgggttcaaatccaaattttgctaccttccaaccagttgagttatttaatcattttgaatctcagggaccccatgtataaaatatggatagtaatcctagtaatgcacacagatatttgcgtgcacacacacacatattcacacacatatttcctggcatatatgttcaactgatgtatcaatgtttccccatctatgaaatggataaaataaataaatgacacctactttttttttttttttgagacagagtttcactcttgttgcttaggctagagtgcagtggtctcggctcactgcaacctctgcctcctgggttcaagctattctcctgcctcagcctcctgagtagctggcattacaggcgcccatcaccatgcctggctaatttttgtgtctttagtagagacgaggtttcaccatgttgggcagggtggtctcaaactcctgaccaaggcaatccacctgccttggtctcccaaagtgttgggattataggcatgagccacggtgagccacggcgcctggccatttcttttttttttttttttttttttgagactgagtcttgctctttgcccagactggagtgcagtgacatgatcttggctcaatgtaacctctgccaccaggctcaagcaattctcatgcctcagcctcccaagaagctgggattacaggcatgcaccaccacacctggctaatttttatatttttagtagagatgaggtttcaccacattggccaggcttgtctggaattcctggcctcaagcaatccgcctgcctcggcctcccaaagtgctaggattacaggcatgagccactgttcctggccaaatagcatctacttttagtgtttattttgaggaaagttaaaggaggaaaataagtacaataaattgtatccataattaataggtattgtggagaggtgtgtgggctactggcaagggtgattactttagagtcagattaagtttgagagctagttctgccactaactagctgtgtgatgggcaggatagtcaacctttctaagtctcattttcccaaactataaaatagcaactgtattagtccgttttcatgctgctgataaagacatacctgagactgggcaatttacaaaaaaaagaggtttattggacttacagttccacgtggctggggaggcctcacaatcatggtggaaggtgaaaggcaggtctcacgtggcggcagcaagagagagaacttgtgcaggggaacgcctctttttaaaaccatcagatcttgtgagacttatccactatcacaaaaacagcatgggaaggacctgcccttatgattcaattacctcccacctggtccctcccacaacatgtgggaattcaagatgagatttgggtggggacatagccaaaccatatcagcaacaattatagaacccacactctagaactgtcataatgaaacacgataatccacagacagcatccagtcctgcacttggtgctcagtgagggcttcacaagttgctgctgttactgttactagttgtattggttatttcattctccctgctgccctccctagctctggaccaggagtcacttctgttgccttgtggggaaggagaggaggacaatgagcaaaagaatccagaaggcacaaaatccagccctttggagagaggaaagtgaaaggcaggagcagctgaaagggacaaattcagagaggatgtgggtttagtggggataagcacctggcactttgtcgcttttattcttgtcttatgccttttccatcatttttatgggctggtgtgcagacatttgttgaaaggactcttccacctggatctcattgaaatcatgcagcctttctcttcactgaatatttttctatcccagtaactatataaatgttccatttgtgatgtaattgttctgtttcagattttctttcctaaactaaaaacgagagttaccccaaacattcgagacaatggcttgaatgtaatgctttgaatgatgaacttttcatttccaatggtttacatttattttttctatttagtggtctaccctctggtgctaggtggaggctccaaagggcaagggttacattgagaggaggatggagctgcagagacttactttcgatataaaaatttccactttttagagagaagcatgagctaaacagaggcagcttttacttgtttggaaatgcaatcagggtccttattttagttgcttaatatttctacaccaaacaaccagcttctgccaaaatcacttttacacagaaaatactctgttgcattaacgggctatggcagtgactttttcttgaagctaatgaactgtcattctacttcttggctctgccaaataaccatgcatgggaggaggaaggaggaatcaggaaagggccagagttttgcttaggcattttcaaacatagaagatggaccacatcttgttcaatgaggagatgaggctgactgttaagctgtttagttgtggtagatgaaaggaggacggcttcaagtgggtcaagccccatttctcctattcacttatttatatgggctgtaaatctcgattttattagccataaaatgggaagataatgcctagatagcagggctggctgaagcttagcagaaattagatgtgtgcacaagtgacccttctctcaagccatttgtgtgaatgtgataatatgtatgaggaattttcttttttcactggaggagaaaggggagtttctataataggtgtctttaaatgtagggagccaagagatggcaggaggaaaatggaagggtggtatgacaactgtgtcccatgccttgtcccttatcctgggcataagtttccctgttcctgactcccccacctctggcctaatgaagtacggattggaggacagcatagccttgaagcctaggtagccaggtggctcatgcctgttatccctgtactttgggaggctgaggcaggcggatcacttgaggttgggagttcaagaccagcctgaccaacatggagaaaccccgtctgtactaaaaatacaaaattagctgggcacggtggctcactcctctaatccctacactttgggaggctgaagcaggtagatcatctgacgttgggagttcgagaccagcctggcaaacgtggagaaaccccgtctctattaaaaatacaaaattagccaagcgtggtggtgcttgcctataatcccagctactcaggaggctgaggcaggagaatcgcttgaacccaggaggttgtggtaagccaagatcgtgctattgcactccagcctgggcaacaagagtgaaactccatctcaaaaaaaaaaaaaaaaagaagtcgtctaggtgacagaagtctcacctgaagatgagcagagccactgttgctcattccaccaaaaatctgttgcaccctaagggctcaggagaaacaccagcagcaaagtgctgctctcaaatggcttggaggccatgagtgagcaactctgaggatccggagagtagaggggtgtgtgtccttattcatgagccaatctgagacagcttctaggacacctagaaggcaataaaggagacttcaagtgatgagggtgtggggggatcagggctattgaaggcttgtaggtctacaggtggaggcttcattgtaatgggagctcacaagttggtgaggcctggagacatgtgaaatagttgtcctagataatatttcagtgtgaatttaaaaagagaaagagaaaggccatgtgaaagcactttgcaaattttagtgttatagaaaagtgcagaattggtattatgaagaagacattctgggatcgagcacagcccctgttagggtggctctgccaaggccagactcacgtgagaggtatcaggtaacagggataccgaaatgctccccaaaggccaggtgtggtggctcacgtctgtaatcctagcactttgcaaggccgaggcgggtggatcacctgaagtcgggagtttgagaccagcctggccaatatggcgaaaccctgtctctactaaaaatacaaaaattaaccgggcatggtggcgtgcacctgtagtcccagctacttgggagactgaggcagaagaatcatttgaacccaggaggcggaggctgcggtgagtggagattgcaccactacactccagcctgggcgacagagtgagactctgtctcattgaaaaaaaaaaaaaagtaaaagaaagaaatgctccttgcggcaatacatgggaattttgttgagcacctgctgtgtcctcagaattctttcatctgcttaggattcaaatacaattaattctcagtctctgttcttcagcagctcactgtccaaagggagtctctctccccggtccacatgctgaggcttgctccagagtgaatgtgtgcactggaaagaacccacacaggccccctgagagctgtcagccttgccaggcttctgtgagatccctgggtccgagtagccaagctgggaggagcaccatttgcccactgactcttgggcaacgctgcagcctgcatcccagccggcagaaggcaggtggtatcacagctgagtttacagccacggaaggaaccactgtaggcttttagtagataatatgttttctctgcttcaaatccttattttggttgcttaaaatttctgcagaaaacaaacagcttctgccaaaattggctcacaaaattagcttactagtataatcagttgtatagcaagtatttactgagtagctcttggaaggcagtcaacacaagagggatggatcattcttccagttcatcacacgtgggttggacatgctaacagtccccgatagctatcaggcgagtaaatggatgatcacacaaaggcagaggcatcgcagaaggatgctaactagatgtcatgcgtcaaggatactacagaaggatctctttgctgacaaggagggtacctctaaggttccttcagatgggatggttctctgttcaccgtgatcactactatgcaaaggcctgtgggccatttaggagaaaagcattcagtccaattccacagacacagtgaggatgtaatatgccctaggcatatatgagtggatccaaggaggaaatactcagtcactactgtcaagaactcatgacctgctgcagggtttgccaaactatggcttgtgggccaatctggctcaccacctattttagtaaataatgttttactggaatccagacacgcttgtttgattacatattgtctatggctgctgagcacccactataagggcaaagttaagtagatagagactttatcacccacaaaacctaaaatatttgactggatggccctctacagaaaaagcctgcgaacctgtggtcttgtgggaggacactgctgggcacagttaactctaattcttggctgtagcatcttgaatagggtggcagtccctggctgctgagggggacagctggacggctgcctcccaggggcatttccatgacttgcaggcccagaaactagacttgggcatgaccacagagttcttgatggactgaagatgcccaaaccacagactgacttgtaggctagaaatgaacatgtggggtggaatagtccttttggggactagaataatttctagagagccaccctttctacatgatacggcgcacattcaagtgtggctacttacactgagactttctgatgagcacgactagacagcagggggcccccaggatagtttgttcaggtcaaggtaagatgagaggagaaactagccctgtcccttgctggacaccaccactccagtgcctgaaatccaacctccccacccccatcagcattcctcccctggaaaagattggaaaatgcaagaatgtgcttctttgactctggccttcctctaacagccctgcttctgttaacacagcctttttgcagcttccttgacgtcattggctacaggctacagctgttgctagtcaaaggcattgttcctttgagctagcaggcactttgttctctcccatgacacattgttttatgagctcactctagaggagaaacattctatccctgtgctcaagttcttcaggagcacctcactgtctccctctgcccacccacctgcacctgacagctgtgggctgtgctctcagggaggcaccgtcagatgctaccagactacagaggagagcaccctcaatcctgactgaaggtttgggaaaaggctgctcagaagaggtgatacttgatatgggccctggaggaggagaagcagtttgagaagacagcagtgagagatggcatccgggcaggcgagaaatgtcagtggtcatggaggcagcatgaagggactgttggctgcagaaacctggcaaggctcttagagacagagacgaagagggagatggggctggagatggagatgatagagacagaaagattgaagatggcagagtgggggctatggggaagggtgatgaagcaggaaagatagatcgaacgagactgcgaggagcctgtgtgcctgggctttattttggaggcaatgagaaacagaaagtgtttttgagcatgatgggacaatgaggagttctgtggtttaggaaacccagcagtcacgggaagtgcagattcaaagtaagaaaacgtcccagggtttggtgatgatcttggtgggaagtgacacaggggtagtggggatggaattgaaagaaaggatgaacttccagagtatggctgtgctcagtagacaggaatcagggagggcaggaggagagtaaaagggtcctctgagcttaaatccagatgttgaggagatggtggtactatcaatggaggtggagctcttaagaggaagaaagatgggaaagaaaaggatgaggtttttgacaagttgaatatggggtgagcatgggtccaactgaaagcagtggaaatatagacgtgaaaaatagatgcggtagagttgaaaagttggggataattttcacctgaatgttacctaaggcaaagggaagagaggtcatccaggacaaaagtacagaatgaaaagaaaaagcaactaagcacgaaatcttggagaatgtcctcattgaagggtgagcagatgaagaggagcccacaaaagagactgaggaattgtcttcattcactcattcatgcatgtattcatttggtcaacaaatattttttggcacctcccatggacaggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagaggtagggaggaaaagatggtaaaaggagagaactggggaggcaagagggacaaatgagggagaagagaagggagaggaaatacaacagaggcacagagtggggatttgtctgattcaagaatcctaggcggggcgcggtggctcacacctgtgatcccagcactttgggaggccaaggtgggtggatcgcctgaggttgggagtttgagaccagcctggccaacatggtgaaaccctgtctctactaaaatacaaaattagctgggcatggtggggcgggtgcccatagacccagctacttgggaggccaaggcaggagaatcgcttgaacccaggaggcagaggttgcagtgagccaagattgcttcatggcactccagcctgggtgacagagtgagactccatctaaaaaatgaaagaaaaaagaatcctatgttctttcccctggccttaccttagaaagcagagtgaatgccgacctaatcaggtttacctccattgccatagcaacctctgggactcactttggtgcacattcttgagacctgaagtgaagaagttaactttatatcaagttacctaccaattaggctagcgatttctctgtcttttaaaacattcttttaaagtcttgtcatgtttcatctttctagaattcatttttcacatcttcattcactgggattctggaccataatatatgtaaacacacaaaatactaaagattgaaaatacaattattctgttttctgattattaaagtggtcattgttaaaaaaaaaagacttggaaaatacaatataaagtagaaaatacaaatcactcatttccccaccactcttagtattctgttgtttttcttcccaatcctgtttctagacacatttgatgacatttaaacatatttttattgtgaatatacagtttcatatatggttttgtttgctaactaattatatcatggacatttccccatgccactaaaataactataaaatcatttcattattcataagcttcacattttagcccttcctctattttaatgcagcaattgtccacctttatacataaatatttgttcctgaatcttaaaagtagtcaaattcgttcacacttcaaaattatttttgtatttactttttcttagaatctttgtgtttaatgtctcattcatttcaaagagcaatattaatacaattgaaagtgatcacagcatcttttgtctccaaatgcaagttattttgtaatgtgatctaattttattttgtaaactccattattaagaaatttgacccaaatttgagaaatgatagttactcttgactcataccattcagccctaggtttccatcaatgcttgtttgaattccatgggtatagcactggtggaactgctttttcagatttttagatttgtcagagaatattaatccttaacctaagttttttttccctgatttctctctttacatttatttgttttcttagtttcattatgatatatgaaactaacatatcctttgtatgaggattcagtggttacatctgaaagcaaacaggaagttattattttgcttgttagaaaaattcacttcccttaatgtagcttttcccattattttactctcaaacatttggtgtacttctgttttacatgtgtttcttgtaagaagaatatggttggatttttaaaaattaactatcttttagctgacaagcgtaattcttttttatttaattatgatcattgatatatttggatttattttcaccatctttttacactttctatttgatgaaattcctactccatttttttctcctccaatattttggaatgtatagattctaattttttaatagttaaagttattaattagattcagcctccttctaaaacctagagtattttaactctttctcagcttataagctagtattgtccagtattttatttctattaaaaagtcttgtgaaatgtatcatatatagaaaagtttacaacatgcatgtatgtatatgcatgtttgcgtgcgcgcacgcacacacacacacacacacacacacacacatacattcatatatttaccattttaagaaatagactatgacctctgctttagaagctcatctctcccaacctctgacttttataactttacaagttagatttattagtgttgatatttatttagatgtatccatgtgactacaaatgtctttgatcacgtggttatctttcttacaacttacagttcacatctcctttctggagaagtatatatatccttctttccaaggtatatatatcctcaagaagttcctttactaagaatctgtccagagtaaattatcttggcttttgttcacctaaatatattctattgcatcctcatgaaagataagttttactgggtatccaactgtaaattgaaacatttttcctagcactttgaagacatcatcttgtaatcttttggtttctgctctgttcatatgaagttagatgtaaaacaggaaagctgtctttttctctagctgtttttaagctattaaatttgtctttaatgttctttcatttcaccaggataagtctgggtgtgaatattttttagaattttttgtacttcctaaatataaggaaccatacaaattattgaatattgtttccatctcattttctctagtcactctttctggaactttcattagatgaatgtgaacacttcttaaactttcatgtgtatatcatgatatcctttttctctctctcaactatattctaagtcgttttgtctcatccaactttcaatttattaattatacatttcatttctaattcgttagtcaactcatatgttgaattttaaaattcaactattttactttcagaagttaatcttttttgatgtttataagagtattttgttccttgcttatgttttaaagtttttttaaatattgaaaacatatttatttataaggcatggttttctggcacactctcggtttttgtagatatagttttattaaaacacaggcaagcccattcatttgcatactgcccatggctgcttttacagtagaatagcaaggctgaatctttgtgacagagactgcatggcttgcaaagcctaaaatgtatactatctggccttttagagaaaagtttgctaaccttgctctacgtgataattccaacccaaagcctgaatgtctgattctactgtttgatgtttctaaccctgtctgatgatgtcttactacatgggtggtcttgtgattttttttaaaaattgtgagctcatttttgttgaggcactagctgtgagaattttatgaggcttgaattggagaacattccttctatttgtgtttacctttgccaagtgtctcgtcattttaaattttttttttggtttgtttgtttaaaatatagtttcagaataggtacacagagtgaatttgaacccaggcttgaggcctgactggtgattatttataatttctggtagggggtaggaacttttattttttcttccaaccaaaatcaaggctaagatgcaaaatcttctttgctatttcctttgcatggcgaacattttctaattcactattttattgggaatgtgggcctttcgggactcattccaaagtctccatgctgacactgcactgctttgtcgcctgcctctcctgtcccccttcccccgacacggatgtaaaaactgaaagctctaatttacaaaacactggcaaatgccctcagggtctgatgcctgctccagtgaatatttaccatgctcattctgaattctggcttccaacttcatttttggcctctggggattaagatactttaatttcttgccaagttagctactcattttatccagcattttaaaggtgctttttgggggagaattttcaggatacagagtctgtcatattgctggaagtaaacatcaggaaatttttaaatgaaaaaaaacacacgattcggaaaatggaaatagaaaagtttcataacattccaacatggttccaagtctacctaatgtttatttatatccgagttatgagtgttgtctctggagtcagacaacctcggtttggaatcaggctctgccgcttactactgctagaggtgagggtgggcaaactttttctgtgaagggctggatggtaagtacagttgtccctcagtacgcataggggattcattccaggacaccccatggataacaacatccatggatgctcaagtcgctgatataaaatggcctagtatttgcatataacctatgcacatcctctcgtatactttaaatcatctctagattacttataatacctaatacaatataaatgctatgcaaagagttactgtgttgtattgtttttaatttatattatttttactgtattgcttttttatttttgttttcaaacatttttgatcctttgttggttgaatcgacaaatgtggaaccctcacatatggagggccgactgtattttgagctttgcaagccatatgcaactactcaactcagccactgtatcacgaaaacagccataattatgtaatgtgtaatgaatgggcatggctgtgttccaataaaactttatttacaaaagcaggcacttagctggatttgaacttcaggctatagattgcacacccctggccttgtacaagttaataaatctctttaagcatcagttgtttcatctctaaaatggagaaaataataactgtgtcatccataggttgtttgagcattagtgaatttgtcagaggcatttgaaccatagcaattccatcttaaataggggtaaaatgagactgagacctgctgggctgcattcccaggagactaggcattcttagtcacaggatgagagaggagatcagcacaagatacaggtcacaaaggccctgctgataaaacgggatgtcataagaaagcccaccaaaacccaccaaaaccaagatggcgatgaaagtgacctctagttgtccttactgctcattatatgtgaattattaatgtattagcatactaaaagacactcccaccagtactgtgacaatttacaaatgccatggcaacgtttgggagttaccctacgtagtctaaaaaggggagggactcttagttccaagaaatctccaccccttttcccccggcaagcttatgaataacccaccccttgtttagcatatagtcgagaaataactgtatttagtcaagcagcccatgccacgtctctgcctatagggtagccattcttctgtttatttctcgaataaacttgctttcactttactctatggacttgccctgaactctttcttgctcgaggtccaagagctctctcttcaggtctggatcaggactcctttccagtaacaaattcatgtaagtgctaatgttagctatgatgtcactgctggaagtgatgatgatgatttgaaaccagtttcttgattttttaagatcataaggtgtctcgtcttcaaatcatttaaatacatccaatgtagcttcctatgctgctactgatgacacacagtagaaagctaacaatactgcagtaacgaacgacccccaaatctcagtggctttaaagaactcagatttaagttttgctcacactacattccatcgcacaggttaatgaggggttctcctcactgtcattcctctggggcccaggctcatcgagcagccaccatcttgaaatcactggtcactacaggggaaaggagctttgaagggtctttaaacaacaattaaatgcttggtctgcaagtgaagtgttatttctgtgtgcagttcacagtcagagttggtcacatctttctctcccactagcttattgcttgggtttctgggcgtgttgtcacagacaagcttcatctgttggctcctccaaggagtgcctagaaattcagagctactcacccagggccatatgcttcccagggcagcccacatccagggaatgcttcctgtgtgggtagaagcccagccctttcagcctgatgtgggacaattttgggatttggctcagcctgttgtttggcaacttgacttctccctctgcccaatcctgctttcctcttttcctttccacagggattgttcccaaggatgttcattaataagcatcctgtacactaaactccatctcagggttcttctccaaaaacccagtcgtgacattcaccatgtgcccaagagagagaaggctggactatctcctgaggaacaccaaggactacctcactcactaaagtgaacacagttagcccttatagatgggagagactaagatcacaaccatgataatagctaatatttattaagcacttacctgccgcatgctgcactaaaatacgttacttggatttgctcatttaatcttcacagtgccctatgtattaaaacaggggattagactagggaatgagaagctacggcctgcagaccaaatctgcccacgcctatgccttatgcattgtctatggctactttcatgctgtaactgcatagctgagttgttgtgacagacactgcatgacccacaaagttgaaaatatttactatctagtccttttcagaaaaggcttgccgaatcctgttttaggtattatttccattttacaggtaacaaaatttaagcttgcagaagtgtgtggtttattaaatcacagaatgtcaatttttagtcatatagatcaaagataaaattctaagtcccccaaccaactgaatggaccccttctcccagccaaggacattccaaagttaatctgaaaaactagttcaggccatgatgggaaaggggcagtcagatacacctcattataccgtccttccttaggaattcaggcacaactgaccagcatcaacattaaaacaggccaggcacggtggctcacacctgtaatcccagcactttgggaggccgaggcggttggattgcctgagatcaggagttcgagaccagcgtgaccaacatggcaaaaccccatctctactagaaattcaaaattagccagtcatggtggttcacgcctataatcccagctactcgggaggcctgaggcaagagaatcgcttgaaactgggaggtggaggttgcagtgagccaagattgagccattgcattccagcctgggcaacaagagtgaaactctgtctcaaaagcaaacaaaccaacaaacattaaaacagagacttaagactgacaaaactgactctttgcagtaataagataccaacgtgacagatagcagaccctgaaagcaactgaagtatattttttttacatattctgaaatggccctgcaaagccgtctcttgtggggaaaatctacattctgtagagaatccccttccctttccaggtcttttccttgatccaggagataattacctgagtctggcatctttttaagtctaataagaaacatttacaatctattttctctgaagcctgctacctggaggcttcatctgtatcagaaaatctttgaatctacctatgacctgaaaaccccctgccccaccccactttgtgttgtcccacctttccagactgaacccatctacaccttacctgtattgattgatgtcttatgtctccctaaaatgtataaaaccaggctgcatccccactacctttggcacatgttctcagggccactggggctgtgtcatgggtcatggtcctaatatttggctcagaataaatctctttaaatattttataatttgactctttttgtcaacagtcatgaagacaaacatttaaacagcagcccccttctgtgatggcaggtgcagactcccccctaccccccatgccactgatgggcctttgtaagtgctcagtgaatgataatgaatgattttcttcccttctcttcttcccaccatccttctttgtaaaatcgaggcctcctcctccatctttgctctaaatcccctcccagacaagttctattttctagagacaagcgtatctgaaattgcaaccctgtggcttctctccaccaagtgaaaaacacaagagacacatcagtttttggtacctttggctataaaacctctggaggaagttctgtttttctgaaaatggctttcttttactggaagagttagggtggtaaatctgtagagcctgagctggctaccaggaaacacttcatgatggctgagaaattattccgcatgctgaaccttaaagggataacataaaatggcagtcttgacagaccccttagaatctaacgctgagattatctgtttccaactgcttccagctgagaagtggctctcagggcagcaatgagtactcaaaagcattccctcatagaagtgattgttcaagggggattcaagagtttaattccttaatgcccatccggctgtttcctagattcttccagaacatgggccttatgcccctaaattcactcccatacctagaagcagaactgggaactgagcccaggttgtttgataccaaaatttgtgcccttaaccatgcatttcactcccttctggtacacaaatatccaggatcatgtatttactttttacagatactgttatatgtgctcatgtaaattgtctggcaattagctgcaagaggattgtaggaagagattctacctatccatctctttacaccatgccttctgaagagaagattttcggagagaatccttggatttagtcaggaatattagatccctaaataaaaatgtctaaaatcctttccccattctttgttgttgtttttgagatagggtctcactctgtcacccaggctggagtggtggtggtgtgattacagctcactgcagcctcaacctcttaggctcaggtgatcctcccatcttagcctcccagtacacccggctaactttttgtatttttggtagagatggggtttcaccatgttgcccaggctggtcttgaactcctgagctcaagcgatccacctgccttggcctcccaaaatgctgggattacagacatgagccaccgtgcccaggctgttttttatttgtataaatttaaggggcaaaactgcagttttgttacatgggtatatcgggtagtggtggagtctgggcttttagtgtggccatcacctgaatagtatatgttatacccattaagtaatttctcatcctcattcttggttccttaaaaaacaactggccctcaaaaacgtctagggaatggtgtacaaatgaacgaatgagtcaatggatgaaagaattaattaatcaatctccagacccttgacaacttaaggatcttgggcacagtttatgctcatgataaacaaacaaaaaaaagatagtcagcagttttcttattgtgacataggcatcagaaggttcacaatcattcatttaacaaacactgaaccttgaccatgaattgcacaccgtattaggcacggaggacgtgacacgcaaggtctctgtcctcagcacaggcaggactccagagatgaggctgaagcatggaacgtagtgtggccacaggaagcttcacctggggctttggccagttgctcatatgtaaggaatagaacatagggagacatacaaagatagaagataccctttctaggaagtgaaatgggagtgcaacatccaggtcgaggattgggaagggttaagtgtaaggttctctggcagctggaagatgtaacccgatccgtctcagcagtagctttttaaacctgggctttaaaaccgggaaacctggaggaatcacagacgctgggctggttttactggtctcccctctctgcttagaaagacagctcatgccttgtatagctaatgtttctttggtggtgagagggacttctgtatattgctcagtttatccatattgtgatgatttgtactagttgcaattctcagagtatgtcctgatctccacaaacgggaagttgagaggacaacaaaagagagatgttttaaaagcactattttaatgacataattctgtaaatattacagtgtttagacacaaatataacaggattctttctacagaactttttaaaccattaatttaggattaggaaactcccctcactccccctagggccactgcttgatttggttaaagcaacttaattcaggttagggtaaaatttaagcaaactccattgctcagcaaaatgctgcctgaaaacagctaaagacaggtcagaatgtccctaaccaaacctcaggcattattaaccaagacctgccttaattctggtttatctcatgatgaccaaggagaaaaaagtcttcccctgctagaagtattctatgtctatcacaaagcaaggattgtgtgttcaatggtcataagagaatggataatatacataagagtttagaagagagagtaaactgaagttaaggtcatttcaaagggcttcatggatgaaaggatctcaaattctaattgaaggagaaggaagacttagttgaggaggtgagagaatttcagaatgatatgaagggaggcttggaagcagcaatttgggtgtcatatttccacagactagtgactgatcagggtctttttttttccttccaaagagtgagaagaaaaatatgaggttggtgcaaaagtaattgaggttttgcaaagtaatggcgaaaaccgcaattacttttgcaccaacctaaataggtagataaatgtagttggaacagaaggtttatttgaggatgtagcccaagattaggttgaaaaattaagaaggaggcaatctgtgatgggccttaggttttagaagagcagacgaggccaggaattgatatgtagaagtggaatagtattttttctcctagttttcttctgtttctagattgctttggtcactatataatgtctttctcagtttgaaggcagacagaaagattatcgggaaaaaaattaggatcaagtgttaaactcaggcagcatcatgttctagtgctattgggtgaaacttctaatgtagacaaacgatataacaattttaataactccctgaaatttaagtaaagaagcaattctaggccaggcgcggtggctcatgcctgtgatcccagcactttgggacgccgaggtgggtggatcatctgaggtcaggagttggagaccagcctggccaacatggtgaaaccccgtctttcctaaaaatacaaaaattagccagtcacggtggtgtgtgcctgtagttccagctacttgggtggctgaggcaggagaatcacttgaacccaagaggtggaggttgcagtgagccgagattctgccactgcactccaggctggcagacagagtgagactccgtctcaatatatatattatatattatatatattatatataatataatatatataatatataatatatatataatatataatatataatatatataatatatataatatataatatatattatatataacatattatatatattatatatattatataataatatattttatatataatatataatataatatataataatatataaatatataataatatataatatataatatataataatatatattaatatataatatattatatattaaatatataaataaataaataaatatatataataaaagaagcaattctagcaactcaacaacatgaaagacactgaagttgaagcaaagcaggaggttccttttaaaactggatcacaatttatagatagctgtatccaaatagagagaacatgattgccatccagccctcaaacaaccttacaggtgtctgggcacctttgaactgaaatttaagcagggaagttccaatgactgaatggaacgtcaaagaagtgtttgaaactgaaataccaaagtaaaataaaatttggaggccttttggtgatccgaaggcaagtatttcatagatttctctgttgaggtgcatctcattttggtgtgcgtccaagtgttttccaagatgcaaactccttgagagcaggaacatatttcctttatgcctcattgaatgcaggccaaccagtggcctgatgaggtttggagggtgtgaatgacaagtgtaaataaaattgtgttgacagctatttaattatcatgtagtttcatgtttaatgttcaaaagttctgaataaatgagcataacaaatctcagtgaaagctaaattaattgacacattttggctagctgcagagagccattttgctgtctttaggagtccccacggtgtgatactcatcttgattatgtaaggcaagtgaggaggggaaaggaaaactttattttttgtgagttccctttttgttgattgacacctctaaatttgtagcaaggcagaccatgcccctgacccattttcctctgatgggtcttgtttcccaccctgtagttcctttttttttttgagatagagtcttgccctgtcacccaggctggagtgcaatggcatgatctcgactcactacaacctccgcctcccgggttcaaacgattctcctgcctcagcctcccgagtagctgggattacaggcgcccaccaccacgcccggctaatttttgcagttttagtagagacggggtttcaccatgttggccaggctggtctcaaactcctgaccttgtgatccgcccacctcggcctcccaaagtgctgggattataggcgtgagccaccgtgcctggcctgtaattcctttttaatacctgcttcacatgcgatgatttgttcaggatctatttacaccaggaggctgtctgctcccagtggacagggtctgtattgccatggccaggcactgagggccagcacgagggcacttgctggtccaggggcaactttgggttgcaatctaacaacatattaattctaacttctccatctaaaatggaaatctgttctgaatttgctgtaaagtttctgtggaagctagctgaggaccctatagttgttcaacaaatgtttgttatatgaaaacaaaagggaagggaagggaaacgctggggtaaacctcagttctacttgttgctcattcctgggggtacgtcatctttttctgcaaagcagacctgtttctaccttgctcacacagcttggtagacagacactaacattttcatcacatgagcccacatgagcctctgctttaattctgcatttgtaaagcttcatgtttttttctcatggaagtagagtcataggtggaggaggtcacacgtttctaaactccctcacccctacttttttttttttttgatatggagtcttgctctgtcacccacgctggagtgcagtggcgagatctcgactcactgcaacccctgcctcccaggtttgagtgattctcctgcttcagcctctcaagtagctgggatgacaggcgcccaccacaacatccggcctaatttttctattttattttattttttttttagtagagacagggtttcaccatgttggccaggctggtctcgaactcctgacctcaagtgatccacccgcctccgcctcccaaagtgttgggattataggtgtgagccaccgcgcctggccccccacccctaccttttgatgaaatggttaaaaatacaaaacaggactgtgtgagtgaataagctacctatttttgggcagtcatgaggtgaagattccattcttggcctgctgcttgtgtaggagaacacgagacttcctgtccctaccactttgtgtgaggtatggggcagccagccacactgtgctagcacctaataaggttgcagatttaattctagcccaaatctggacaaactgatgttcaggttacagctagctgatgttcagaaaaggctgccagaatcctaatgagcagcctgaggaaatggagccgtagattctgtttaaaattctctcctttcattttttcattttctccatctacatctctgtctgctccctttctcattcattgctttctgcttccttccccctttctccattcattcctcttccttctttgcctctatccgtctttctgcttttctttctgcctttctgtctttcccttctcaccctctctctcctgcttcctctcctctcactttcctttccctcagtctctctcttgctcttgctctttctctctcttccttttatctacagcctattggcttctcatttcttttccttctcccctcccattttctttctaagaatttcttgatgaaactaaaagaggactaaaaggagctccatgaaatgcttgcctggaagaaaacatggctggatgctcttctgatcataggcagccactaaatttgatttgtagctgatcttaaatgtaggaaaagattttcaattacaaaactcataaagtgtaaagatgagggaaactggccatgctttgagtttgactaatggtctcaaagcgctttaaaatgtttggcatttgccagcctttctttcttctcctaatcctcaaactcatgagtttttatgggaaacataatcctcttttctgattcatttacacttagctcatctgagtattgttttgtaaaaaccatctgaagtccaagaagttttatgagatctttaaaggcttgttttttgaaccaggaagttgtgtactgccaacataaatggaccttgaactctaggggggtttgagtccagcatccatagcattaaactgggtctagaattggcaaaggcccatcctcatggctgacagaaactgggctttcaccttcagaataatagtgagttcagtgtttgggatgagtgaccatctcagatgatagtacatggggtgcataacaggtttttcaaggattatcttgctagttacgtaaatagcaagagacttatgtggaaacctgtgattttgctggagtctcccaactacagagtcgggctgcttgctcatgtgtatatttccatattaattgtgtgcatacacacatacactaatgtgtagacggatgggttaacattcacactagagatttatttttgtatttaaaaaattttttttagttttagtcttattatttttttgagatggagtctcgctttgttgccaggctggagtacagtgacacaatcttggctcactgcaacttccacctgcagggttcaagtgattctcctgctttagcctccggagtagctgggattacaggcatgtgctaccatgcccggctaattttcgtatttttagtagagacgaggtttcaccatgttggccaggctgttctcaaactcctgacctcaagtaaactgcctgccttggcctcccgaagtgctgggattacaggtgtgagccactgcacctggcctatttttatttttttcagagttggggtttcaccatgttgcccaggctggtctcaaactcctgacctcaagtaatctgcctgccttggcctcccaaagtgctgggattacaggtgtgagccatggtgcccagcctcacactagaggtttttttttttttttgtttttttttttgtttttttcctgtggttttgtttcagagatgatctgattgtgatatatccaaatctgtcataaggcaggttgtaattgggttaaagattggtgtgaaatgcccacctcgccattgctgtgggttgagaggaaaactgcattctgcattttttaatggttaaaaaacatttttctgcagagccaaagggcctggttaaggtcatttctcccccaaacactaggatctcaggcagagtcccaggccttctggaaactgaggctcagagaggtgaaatgtcttgctcaagtttccacgggaagttgatatggtttggctgcgtcccttcccaaatctcgtcttggattgtaatccacgtgtcgtgggagggagccggtgggaggtaattaaatcacgggggcggttaccctcatgctgttctcctgatagtgagctctcaggagatcagatggttttttaaggggctttcccctcttttgcttcggcacttctccttgctgccgccatgtgaagaaggacgtgtttgccttccccttctgccatgattgtaagtttcctgaggcctccccagccctgcggaactgtgagtcaattaaacttctttcctttagaaattaaccagtctcgggtacgtattagcagcatgagaacatactaatacagaagtaaagcagcaggtagagcccagccccctagagtccccatccaggctgtgccctccacaggtagctgccacttattgcccaaaagcagctttaatgcttgccatctgtccatctggggactgggagtgaccaccactgaagacaggtagaggctggtcctgttggggatgctgtcctttactctttcctgagctttcctctgtctgacatctctcctctcctgtcctggctctgcagaatgttgtagctatgctaatcaccctcctccccacctccaaccatttcatctgctgttacattatccctacctgagaggtaagagctctgtgaactgatctgagttgcaggtaggaagtattttccctacatgttggtgaattttccataagatgacaaagaattgtgggctgtactatgatacaggcatcatacaaatcaggtcctcccttgtgagaggtctatcatgatctcaaagtgttgcttcattaagttgttatcatttttaagctttcatttacatcttctctccctaacaagacacgaagtttcttaaagacaagggctttatgccttgtgatcctttgtatttccacagcctcagtgcctccttcagagatgcggtggatattagcttctgttgtatccttcatacagaacctggtgctgagagacagcttcttctttttttttttttctttaaacttttcttaagactagtcaagtacagtatcaagaagacgggaaagagtagaacaaggaattggatccgtaactgactgtgaacaatcaattgaggtaactcattacctttgaaccaacctgggaggcagccttgtgactcacctcaatcctcaatcttctcagctagttcactttggcctggctcaggggctgacctagaatgatcctgtccagaaggaccctggatgttcttagagacacagactgctagggctggcagggacttttcatccaattcctctgtgacagaggaggaagtggaggtgcagaaggagaggtgagctgcctgtggtccttcagcttactaatggcagtgttaggactggacctgagggctcttccctccagtccggcgctatttattccatgacagtgcctctcaaactgtgttctcacaagcagctagtgctcaggcagctggactgaggccctgcctgccaaatcaaatattggaggtctttctccaatgtgcagaaaaaaaaagtaattaatgggttaagtttccttagggttaaattatttttccattaatgcttcttaaaccattgtcacctgctaccaattgtctactagccaatgcatgcaggcaacaaaacaaaaggataagccacaagtaaataagaacaagaacaaccaaagccttggaaacacaccatcattcttaagttaaaggcttaaaaaaaaaatagaggaagactgctatgactgtggactttctattgcattcacataataaaatcatgcgacattgttttgaattcaaatgctaaaagtaaatatgtcattatttcatggttttccccaaagagcactatgaccccccagactctatccctggtacattctgccatctctcttaatgggtcaggtcatctccaagttgggtgacccggtcggattacggtcccgtgaactgattcgcctttattaaaaacaataatggcttagggttttcagggatcctgaactctagtcctaccctaaaggcccagggacagggctgtctctgcggttgtccctgggcggttctccccgtcccacgcgggcgccctctgctgcccgccctgcactcccatccctgccaagcgagaagtagggtaccagaggctgcacaccgagaagcagccacggggactttacagccccacagggagccacctaaacggtttccgatggagacctcagcgcgccccgacagccctttctggggcccgatttggtatctgaattcaaccccgcagcaagtatcacagcaaacacggataagaaaatgccggggcttccaaacaatatcaaacgcatggggcttctgaaaggacaggatcgttcagtaactttgctgagcgctttgtcctctcccgggacacgggaccggggcgtggggacctccgcctcggcgacccacgggggcaaccccagtggatgtggagggtggcggcgcgccttcgggctcctcgcacgccttccccaattaggatctgccgcctgacgtcacgtctgccggagattggctgctcaggtctgacactcggggccacgggagagaaacttttaaaagacttcgccgccggggctgcctcggagtgtcccgcgcgctctcgctcgctctcggccaccctcgccgggccccgctgcggcgcgcgctgcaacccccggccggacgcgcggaccctcaccttgcgcggcccgctcccctcgcccctccccgctccccgggctccgcgctccccacccccacgccctcctcctgctcccagccacaatcggccggggtctggggccgctcagctgcccgcagagcctcctccctcgccaccgacttggtctcctcccgcctttcccgggctctcggcagctctcgggggagcccgaacgcgcggggaaaggcgagccgcacggccgggggagggggccggaccgcgcgcgaccggtcgcgcccgctggggcccgcgatggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcaggggtaagcccacacccccttccgcccgcccgcccgcctcgcgcgcaccgcccgcggagggacctgcggggtcagggccactcggagccccgcggtggccagggcggtcgcgcgcggtgggtcggctttctcctcccgcctccgcctgctctgggcgccgcgggaagaggggagtgcggggaagcccaggaacttttactgacgtgaaactccgagtgcattgttaccgagctgcgggtaaacacaaaaggcatttctgcctggggcgtaaccttctgcgcgcaaacccaactgcttctagaagatgggcgtaaacttgaggtcactacagtttaatccctcagcatcaattaaactctgcaactgagttttaattttggtctagctaatgaaaaaaatgtttcgagggcgggctagccgtaaagatccagctcctgttctgtggcctggaactttgcagcatcagagaaatcatgggcttggacttcgctgcacctgtggggtctgctttcctggggtggggtgtcttggtattgataaaagttttggttggaatgtttctgttactgggcgctcatagtgccttcccgttgtgggaattcatctcaggttggggtgtaggggaaaacttgttttgcttagttggcatgtttttttcaggggtgattccaggccatgtgccctcactcctttttggacagttctctctgaaactcatttccaatttaaaatgttggcccagataatagaaaaaataaatttggctctactgtaatttgggggtaagaaaaccatttgttgggccctgttctcccttcctgtatagccctaggtttatgcaggctttttggttctcccagcattccctgatatatgtatgggccttgcccctctgcttgggcagctttgggttgggcatccagggtacctgttaggactctctctcatccagagggttgcagaagctggaggctggcctttctggaacatgctggaagcttgggttcttgggaagggggtctttctgctgctggactcagcgatcttgctttgtttcagggtcaatgtctgtggagggcggtgctgtcatggctggagtaaggcccctggctcccagaggtgcaccaaacgtaagttgccatgttcacagtggccctgcacagtaggcaaagtggggggaggtgtccacatgggggcatctcacaagggccacttgaaagggctcgggggaagttgaagtctgaaatacaatccacccaggcttcattaccacctaggaagggctgggtcagggtaatgttagtatcaatgccagcagcaatacattgtacagaaccgtgctgtgcatccaagacttctctgaactcaacagagatattcatcattctggcacatctgtgaatcaggagctaggaaaaaaatttccatttgaggatatgccatatggcagaaccaatgtaattaatttgaacatgataccaacaaatgaaagacattctttacggtgatggcaggaggggcttggggagtagagggccctgttctggagtacaacatcaaagtttttatagcttcctgaaaacagcaaccagaatccttcatccttgaggcctgatggttttctagaatgcacttctctgctgctcttcagaactgatggatggggttctctgcagtgcttctgcagttcacatgcatgcccagcagtgttttttaaaaaatgtgttaatgatgcatacagatttcagaacactggaaaatttttctcctatgcattgtgaaattaaagatcagattaaaatgtattttgaggttcttcttgacgaattgatgctatcgggtgctcattggacataaaggagccttaccttccccctcagaaaaagtgaagcattcttagttgttctttgcatagagattgaggcattcccatgtggattggaattgtccaaaatttctgctgcttggattttaaaatacaggtggatgaattttaaaaattttggatacagtcaatctggtgaccttgtttgttgaaaatgtcttcaatcctgaaggaaacagaagggttttggcataatggccttacttttgtaaaaagggaaatgtccacaggttttatgatgtgttatgatcaagcagtaattgcagacatgaacagtcttctgactattgaactcaaaccactagatcagaaatgctcagggttctaggcattttagattaagtcataatttttcattttgtaacttcttaaattatacttgtcagaaatgtgttagcatttgtttagaatttagcattgctcaggccaaatgacatgtcccctctcccctcagtaactcattctgtccaaaacctgctatgatatggtttgcctgtaacatggagataactcgtctgttaacagcaccactgcaatgggatattgctgagtaaaggttaaaaatacggaatagggcctggtgcggtgactcatgcctgtaatcccagcactttgggaggccaaggtgggtggatcacttgaggccaggagttcgagaccagcctgggcagcatggcaaaaccccatctctactaaaaatacaaaaaaattagccaggtgtggtgttgtgtgcctgtaatcccagctactggggaggctaaggcaggagaattgcttgaacccaggaggtgaaggttgcagtgagccgagatcgctccactgcactccagcctgggtgacaatgactctgtctcaaaaaaaaaaaaaaaaaaaaattacccagacatggtggtgcatgcctgtaattgtaatcctggctactcaggagtctgagtcaagagaattgcctgtacctgggtaggggagattgcagtgagcagagattgtgctgggcgatgcagagagactccatctcaagaaaagaaaagaattcagagcaggattttacagataggcagaagctccttgatgcctgttggagagaatgctcaaaggctttaataagtttgcttggcaaatgatgcaattgagtgctgtctctgaaaagaggataggcccccattttcaggttgcttggggaattcggggatccaaagatgttctagaagatcccaagatgttccaaatcttggggaatctcttcatggcttcctgcttctgcaggcaagagaggcaaagaagtgggtgcctaggtttagctgggtttgccccctggtaatccagagagagatcacagaagactgctggtcagaaaaatcagtgttgaagttacttacagggctctagaggaagttgctatgttggtttaatcttacggtacctacaaccaatgcttccagcatttggcttaagttttcctgctggcttctaagaggtagcccttggacagtaccagcatctaagcaatgtgacatcactttccttttctgtggttttcagcattcagaagattaaccttcctgtacttcccagtttaacaaatgaatttaggtacaaatgctagaaacttaattcacagctctcttcagaaataattatgtttttaaaaggcatgctggggtaggtcagcgtgcgatccaaaataatgtatctctgaggtggatatttaaaagaggggacttactttgcatgtgtctgggagatccagggagctgagagagccttctaccttcagatgggaccactggggctcctgctgatgctataaaccttgtgtccatggctgagtagtgtgatgccaggaaagacccccggctttggggtcagaagacctaaattcaaatgctgcagccctcactagctgtgtggcctcagggagttcacttgacctgtctggcctgtattttcccactcagaaatgactgtgctaaaatcttgccttctttataggatggttgcaggtattaagatgaaaaaaaatgggtatgaaagccttggtgaaaccagaaagattaatattagagattagtattggatcaagccaagtaaattctatctcctttgtcgatgatttggttttcttctgtttgtggtttcctcctctcacttccttattatgcggagattgaacaattacacttgggtatggtttattacacataagaatacaaaaaccaatgatacgcccacatgaagttcccccttataatagtcatcataaaatatgcatggacatttaaatgtataacccaggatgtcttctaattgtcattacatgttgaagataatgaagaatttgagtttatataggtcatgtgcaattgatgcgaaaaaaatttctgtgtaagaggttggaagtgttcatgttgttcagtatttgcctaatccagtgaagaaaataaggtatccctttgagaaagcctggattgtttttagttgattgaaacctaatttaaatggaccatgatcaaatgcttctgaagactaaagatttagtgaaccttaaattgcaaatcagagagatgtgaacaagcaagcggcagactcacacaagggcaaagaatggatatgtgcactcaccaaagtggtcctctaggctgtagctgcccagtcacaatgtagagatgcctggttgcatgttaatgttccttttccagacaccatttgtatgtggatccctaggaatcgaaattatcgtgtgggatgtgtcattttagttaatattggatgactcttgatagccttacctgttttggacaaaagagatggagagatggaccacatttgtgctctttccaaggaattaacacttaaaggaatgttttgtgggttagggactttgtcttccaagtggggcattaaacccctgatgtgtaacatttttgcctcctatcatttttgtagttttttttttctgcgcccaaactgaacctccccccatgccctgcattggttctgccagtctttttgcccccgtctcagggtaagtgcaggccagacagagacattgccggtaggctcagctttaatgagaagactggacacgggaataggcaatacaaaagaatgaaagagaggagagtgaggctgggctggcagggttatggggtagagggaagagagatgatggcagatacgaatccaaagcgggtgcctggcacattgcaggccttccatacacgcatggatggttctttcatttactgtttagcttttaccatgtgccaggttctatgaatagaggagaaacacagccagctgtagggagtgcaggtctgtttttactcacttaactcgtggcacatcaaatgacttgttctctccttagaaagaaacagaaaatcgatattccattgcttttccattggcattcagcccatgctacttttggggaaaaaacccaactctagacattttccttaaattatatgcaaaggagacagagtcacatgcacccttggtgctcagagatgcagtggtggatggcatcatccaggagggtgtgatgtggctggagttcaggtgacctagagaacggtctcaggctgtcccccatccctcttggcttggcatcgtgcttgccaaacttgggagtcgagcccagagtgattatatatttttttgtatgcctgctatggccattggcagctgctttgccaatagatctgcagtgaggtttaccatgacaactgctaggagggccaccccggcccccatgtgggagggtcagctggagaatcttgtcatgtgacacagacaacctcggtgaagagagaggaacccagaggtcaagttcacactaggtcaaatatgtgttctcgagactagttaaaatccacatttaggaaccataacactgtaatagtgcttaaaccttcatgatgaagccctcctccggcccatgggcctgctgaggatgccgcccgccccctgcctgctctgctttatcgaagtttttgctgcccagtgaaccctgggcccttaggaagcctgacttgttgaaaagacctttgacaaccacagggttttgctgtttctgaccctgttatttgttgtcttggatatttcagacgtactcaaacatgttcgagagctcaaattaaattttcctaaagtgcagattttgcttcccagtccttcctagcaatgaacagaggcgacttggagtgtgagggctatgtcaccacccttttaatacggaccaaaatcaggtccagcagagaggagctgccgatggggtgggggtaacttgtgtggtgctgtggagcttacagagagcattttcttgatcttcacaccctgtagtgtcattgaggcagggatgctttattaaccctattccagacagtggggcagtgctcagatgccactgcagatcttgtggctcttcctactgccctgggcttcctggacatccagtgctgtgacattctttcttgaggtcttggtctgaaaactgtcctgacagtcctcagttatctggattggcttccactgcctaacttcacatcatgattttccaagctatgtgagttttctcgggcttctgtaacaagttccacaagctgggtgacttagaacgatagaaatgtattgtctcacagttctgcagtccagaagtccaatgtcaaggtgttgatagcgttacttccttctgaaggcagttctaggcctctctccttggcctgtagatggccgtctcttccctgtgtctttatacattgtcttgtgtgtgtgtctgtctctgtgtccaaatttcccctttttataaggacatcagtcatactgtattagggcctccactccccgcccccccccaccaatgatcccattttaccttgattacctctgtaaagaacctatctccaacagtggtcacattctgaggtacttggggttaggacttcaacactttgtttttttttttctagggggagtacaattcaattcatgatgtaagcctgcagatgccttgcacataggttggagagatgggctattcagagttggctcattcctggggcacttgggaaccctagcagctgacccaaggatgggtgggcggggctttgactgggcccctgccacacaatctgtgactgtggatctaatttggttacttttctactgcagcagctctggctgctccagggggtgttaggagagatgaggaattggccacaggtaattttggtgatgcctctggccatttttactggggctcttttaaagagattctaggttggtgtttcttacacatgaatgtccagcgggaccactggaagggtttgttaaaatgttgaaagttgttaaattcaacaaattgaatcaaaatctttggggtttttaacaagcatcccaaatcatgctgatggaggtggcccacagtttgagaaactgatctggaaggaactcagtcctgggcaatatttatgaccctttatgtgggaatttaaaggccaacctcaacgcttagcaatttagagaaacctctcaagcaaggcaggaaccctctaaacattgggatagctcggatttgaagaatgtatatacagtcaaagattgctgcacatgcagtttttacatccagtttttctttagttagttgaatgtttgaagtatatatgtgtatttttgggagagctggaaatttgcaaaattgttgctgcatcagtgattatgtagagtgccttttaaaaaagatttaaacactttggaacagttgggtgttttcttccactaattttttttaattacaaaatttttaaagttatatacatgtatatttttgcgagagctggaaatttgcaaaattgttgctgcatcagtgattacatagagtgccttttaaaaaagattttttggaacatttgggtgtttttttccacaaattttttttaattacaaaatttttaaagtacacacaaacatagaagctgcccatcagggtcatgtttttaaaagctccctgatgtggtagttaagtacaatgatttatacataaaggagaaactatggtcttatctttctgtaaatgcgtgttttactaatggtttcctgctttcttagtggagagaaaatattacataatttgttggtgtgacacaaattggttgttttcgtacttatggaaaaatacatcagggttgtatttgcaagcatacctcagatatggagggttcagttccagcaaatatctcaataaagtgagtcacaaattttttggtttcccagtacatgtaaaactcatgtttatatactatattgtagactattaagtgtacaataatagcattatgtctaaaaaggcaagtgtataccttaattaaaaatattttgttactaaaaaatggaatgatcaagtcagccttgagtgagtcattatctttttgctagtggaaggtcttgccttgatatggctggttgctgaaagttggggtggctgtgacactttctttaaaataagaaaatgatgaagtttgctgcactaattgactcttcctttcgtgaaagctttctctgtagcatacagtgctgtttgatagcatttgacctactgtataacttctttcaaaactggagtcggtcttctcaaacgctactgctgccttatcatctatgtttatataaaattataaattctttgttgtcatttcaacaatgctcacagcatcttcgccaggagtagattccatctcaagaaaccaccttctttgctcattcataagaagcagctcctcatctcttcaagttcgaacatgagattgcagcaattcagtcccatcttcaggctccacttttaattctcttgctatttccactacctctgcagtgacttcctccactgaagtcttgaactcctccaagtcatccatgagggctggaatcagcttcttccaaactcctgttaatgtggatactttaatctcctcccgtaaatcatgaatgttcttaatggcatctagaatggtgaatcctttccagaaggttttcgatttactttgcccaaatccatcagaggaatcactatctatgacagctatagccttatgaaatgtatttctcaaacaagaagacttgaaagttgaaattactctttgacccatggactacagaatggatgatattttagcaggcatgaaaatgacgttaatctccacgtacatctccatcacagcttacaggtgaccaggtgcatagtcagtgaggagtaatattttgaaaagaacctttctgagcaataggtctcaacagtggggttaaaacattcagttaaccatgctgtaaacacacagactgtcatccagtctttgttgttccatttacagagcacaggcgaagcagatttagcataattcttaagggccctgagatttttagattggtaaattagctttggcttcaacttaaagtcaccagctgtgttagctcctaaaaggagagtcagcccatcctttgaaacattgaggccaggaattgacttctcctcagttttcttcaagaactttttctttgcattcacaacttggctagctggtgtaagaggtctagctcttggcctatcttggctttctacatgccttcctcacttagctttttatttaaagtgagagatctgtgagtcttccgttcacttgagcccttagaggccattgtagggttattaattagcctgatttcaatattgttgtgtctcaggtaatagggaagcccagggaaagggagagagatgagggaacggctggtcggtggagcagtcagaacacacacaacatttctcagttaagttttctgtcttatattgggtatgatttgtggtgccccaaaacaattacaatggtaacatgaaagatcaccgatcacatatcactgtaacagacacattaataatgaaaaagtgtgaaatattacgagaatttccagaatgtgacacagagacagaaagtgagcacttgctgttgggaaaatattgccagtagacttgctgcatgcaaggttgttacaaaccttccatttgtaagaaacacagtgtttgtgaagtgcagtaaagtgaagcaaaataaaatgaggtctgcctgtacatgcatatactgatgtgtgtctgttaatttttcctgcctgttacggattgagcacgtcatgtagacacagtccattggatactgcaattctgtgcatacattgccatcgagaccccaagactgtgtggttataagaaggaagtgccactgcttactcctctcctctcccttctatcttacctgcttttgttgcctttctcctcttcctccccttacttggtctcagtttggtttgtcctgaatgacaggcagtatggctcagtggttggaagttcagtctttggaattagaatacggagctcctaattgaccttaatactttctcactgtgtaatctcggacagtcaagcttgagacctgaagcagggctaagttaactccattcacaaaataggaataatgatggtctctgtcatcatccaggggcttgctacggggctgcattaggtaatacattaaaaacgcatagagagcagggcccctgcacagtaattgacaaaaatgagctctcagcacctttcatttgtctgctcaggaccacttcctcctgggtaccactgcttcttccatgcccctcttctaagatccttgggggctgatcctgtttggtgctccctaagcagattctatttgatgctccctaagcactctgatttcactcttagttggctctgggtatggctgagccaggtagaagaggcatctgtcccttcatcagcgttgagctcctgggaagcaggtcccttgctttgccacagtacaagtgccacagtacaaatgctacctaggaatagaatggagttgagtcgaagtagcatttctgattttgcgatgttgctaatgctgtcctctaaatactatagaaagaattctttttcttttctttgtttactctcaccttttggcaataatttccacttgtttttctttcctgctttttctctctgtacttttccttgcccagcagacactgctgattgtgacagctttttcaagggcacaacaccttactctgtttcctcctgcctttgctctgtaaggctgctctggcatggcccaaactttgagatgacttttcctttctccttgccaattttagaatctttctgttcaacatcatcatctgatagagatttgggactaagtaaaatgaatgttgtatgattttccctgtaattttagatccccaaatactgctcttggccaactacactattccctgtggcttttttactccaccacatttgagtaatattgttggcatggacataagtaaacagtttgaaaatgttgtgttttgtaaactagaagatggatgggctggttttttaatgcatgctcttggttctgctgggccaaaggaaagatgaatttggtcagtggatgggaagatgaattggaggaaggtgttgctatccgaagttgatgtggccaactttactgaactgatgagatcagttatttagaggtgaaaaccgagtggctggaggcgactcttcggagggatttagataatgcagttagagggaatttttatagaggagatagcatgctaccagtaagaagccaccaatggaaaatatgataataaagtaaggaaaatagaaggataaggatcttttgtctttgtaaatttaaacatgtttttatttctttgtagaattaccagacaattccaatgtggcttttaatctttcatgaacttcattttattattgctgtatatatatgtgtgtgtgtgtgtgtgtgtgtatgtatatgtatatatatgtacgtgtatatatatatatatatatatatatttttttttttttttttgagatggagtcttgctttgtcgcccaggctctagtgcagtggcgtgatctcagctcacggcagcctccgcctcttgggttccagcgattcttctgcctcagccacccgagtagctgggattacaggcatctgccaccacacctggctaatttttatatttttagtagagatggggtttcaccactttggccaggctggtcttgaactcctgacctcaggtaatctacctgccttggtctcccagagtactgggattacaggtgtgagccactacacccaccctattattgctatttttaattaaaatgtagagtctccatcctcccatatgcatttcatgttcacaccatagcgagtagacagttaacacttagcatcttcaaaatatgattattgtaaaagctatttaaatgagccgagacttatcacttcaccttcataaatcatttactacaatgattcaagggtgaggatactcctgcctcttcattggctgtgaaacttcaagcagattaatgaactcctctgagacttttctcaaccttcagacgggaagagtaccctcatcacacaacttcattcatgttgttgtgaatgtcaggcatacacatcctctttgctctgaatgcttgtcacattgcatcacagacatttatgtattgtctggcattgctgcttgaatgtgagctctatgagggtagggattatactatagccatctttttgtcttcagtacctggtaagcatgtacacctttatggaatgaatgaatgaatgaatgaatgaatgaatgaatggattgatttgttgtactttcaccaagctcctatatagtaggttttggtacacggaaggtgttaagatgactttttctttctccctgccaattttagaatctttctgctcaatatcatcatctgatagagatttgggactaagtaaaatgaatgttgtatgattttttttccctctaattttagatccccaagtaccatgtacttgaaaaaactaaaacagggtcacaggctagagagtgacaggagctggaactggaggtggggagagggctaaaagaaagtctctataggaagtgacatgtgaggcctgtgtgatatgaaagggtctgagagaagagtattttaggccaacagaatggctagcacaaaggccttggagtggggataggcctggcttgttgtgggaacataggtcattatcgttgggttgtcagtgagggctgctgtaataggtgatataagatagggttggatcccaagtcaagtcttctaggctgtgtgaggccacagataagataacaagaggggactgtacaacacaagcacagtcaacacaagtactataaaacacgagtgcatgcaagtgtattttattactaagaaattaaagaaaataaaggatttagtattttttaaggcatggaaaaatatcttacgtagaaaattcattagatcactttgattgctattttttattgatgagaaaaactgcacgtggaacagtgaagtacccaagtccacacacaaattattctcatagcctgaccacctgcctggtgcccagattgccagaccagccttgtgctgactggacctccgggtctctgccgagctctcgtggaaaggcaagaccctcagcagggagctgcgaggctgcggtttaggatgaaagtgtgagggtgaagaaagccaagtcactggtcactattgtgttaaaagtcaaattaatggggatccttacatggtactaaatttaaaaaaatgttcaatcctttaaaaattgattaaaaattttattttgatgatcatagaaaatctacagagagctgataggatgtgttaaagtggaagttaaatatttttggaacatttgtatgctcttctgaggttttgttcatcccccccacctcaacatctaatttacacgttgaattagtcattgactccgcctgccattttgtggtaaagatcaagtcaaatgaggctcatcacagtgcttcacaaaaggggccgggtgtggtggctcatgcctgtaatcccagcactttgggaggctgaggctggcggatcacctgaggtcaggagttcgagaccagactggccaacatagtgaaaccccgtctctactaaaaatacaaaaattagccgggcgtggtggtgggcgccggtaatcccagatacttgggaggttgaggcaggggaatcacttgaaccaggaggtggaggttgcagtgaatcaagattgtgccattgcactccagcctgggcaacaatagtgaaactccgtctcaaaaaaaaaaaaaaaaatccttcaatgcttcacagaagggccatataaacataaggtgaccttattaataaggtttttatgaccagtttgtacactttttttaataatgtgttggtgcatttcttgtcttgaaaaatggaatgcataaaatgtacccattttcaatgagtttttggtaactaaagaattggtgtctctgatgtttatattgaccatcgagtttaccaacaatgtctctggtacacctcctagaagttggtttgaaaataaacaaaaacacctacatctccactttaattctaccctccctggaatttattttattctcctaaaagtagggttcgtgcaaagacaagaattctttcaagagagccctgtttcttttattttgagatagtgaaaaggttatgttaagttagtccaaaatttcatagtaattgaaggtgaaataatacagacaataagtaaattaaaggtagagactgtttttgttttactttttcatccatttaggagattggcctacacagcggttctctttatatacaatagaccctcagtaaggtttcttgattagtaagcattgcaagttacgtttgtttcgagtggaagaccagctgaaatccatttaaatcaatgaatactgagattatgttattaaatggttctttttgttttacgagaatgtatattacaacaaatgtccctgtgtaagtttggaatgctttgttttgagtgttaaaggctcttttctctggcaaaatttccccatttcttcctttaatacagagtgcttgaatggcacctcacagacacttagcctcgtggctctcaaagtatagaccctggaatggggcgtcagctccgcctgggaacttgttagaaatgcaaactctccagccctgttaaaccaggagctctgggatggggccagccatctgtgttttaaccaggcctcttggggatcctgatacagctgtggcttgagaaccactgctctagcagaacccatctcctcctccctttccacatccccccaccctactgtgatcacttgtggtgtgatgagggggacagggaaatcagctcttttgggctccaggccttgagagtagaggcttcatttaccctttcccccttcatttctgcctaaggatgagtttatatggtataaagcccagtggaatggatcattttccccagtttcagatgggaaccttgcaatcggataagatgtagctgtgtatgttgttactgttattattaattgttattcagagacaaggtctcactctgtaacccaggctggagagtagtggcgtgatcatagctcactgtgatcttgcactcctgggctcaagtgatcctcgtgcctcagccccccgagtagctaggactacagatgcatgccaccatgcccagctattttttttttttaacttttttgtagaggtgaggtctcgctgtgttgcccaggctggtcttgaactcctggcttcaagtgattctccaaccttggcctcccaaagtgctgggattacaggtgtgagccactgcacctgaccaccatgcacattaatacacattctatactgtatgctcactgaggagtggcaaagaaaccagttttcattcagtgaatatacctataaatgtgttttgtacctttaggtcttcctaattctgttctgttccttaacataaaagatgcctaaaccacacttcttcatattcttcaaagccacatttatcaaggtgtggttccaggacctcctacaacagaacccctgtgggatgcgtaacaaatgcaggttgtgggactttcccacacacctaccaaattggaacccctggtagtagaccccttggccctcattttcacaagcacccatctgactgatccacactgaagcttgagggccctgagtttaaagtacatatgctggaatacaagatatcaaaagcgaagaatgatgagaaagagattgcaaaattaataaaagtaacgaaggagcaacattttattttagaaataggtgccattacttgtttctaaaataatttgaaagtgaaatgaagaacaagctcttgtctagagcatactcttggaattggcagggattgtgcttcctcgcgtcaagatcaagaagctcagatgcagaggagacagggctgtgctgcccagttgttccttggggtcatgctgactccatcctggaagttgctggaggaatgcatcatatgtttggaaacagcccagttgagaatttcagcaatgatacactttttttattagatgtgtatttaggaaaggaattgcctattataagactagggccctttgtagaaggagctgaaaaaggagctggtttgcttgtcctgtgaaatagggactgttttccccattatgcatcttttcttttctttccacaaaataaataaatgcaaagacatgtcacttgaatgttgtataaaaatcaggtcttttaaaaattacttgtttctctccaagtagaaaggcattttttccccaagggaaacttattaaaatcatcagttattgtagtaatagctatgcctccttaaaagtaaatagatttttttttcttcccagtgccagtagcatgtagctatttccaaatatgttaacttttgatgaagcatccaaatgtttaaatatcttataaaggccacagttctaagaaatggtgttaaaattttgagaaaattcaaatttgaagaattacctaaatactaagtaaatcaaaaagtatttgtaacattaaaaaaaatttatgtcaaaaatattttttaatgtcaaaaatatttttcaatacttaaaaaactagcactttgggaggctgaggcgggcggatcatgaggtcaagagctcgagatcatctggccaacatggtgaaaccccgtctctactaaaaatataaaaattagctgggtgtggtggcgtgcacctgtagtcccagctactcgggaggctgaggcaggagaatcgcttgaaccagggaggtggaggttgcagtgagctgagatcgcgccattgcactccagcctggcgacagagcaagactatcttaataaaaaaaacaaaaaacaaaaacaaactttagtccttactccttcagtctcagttgggaaaaccatagaataatgaagacaaagttacagattaaagcaatagctccatggtcaaagtggacagtggagttattaaatagtgtatttaaatagacttttgagagaagttttaggttcagagcaaaattgaacagaaagtacaaaattcctatatacctttgaccccacatacacacaacctctcccaccatcaaaatcctgtccctgtcctgttacaatcgatgaacccctatattatcacccaatgtccatagtttatattagggttcactcttggtgttgtatattccttgggttttggcaaatatataataacatacatctacagtatcatagagaatagtttcactgccctaaaaatcctctgtgccctgcctactcatccctccttcctgtctaaaccctgacaaccactgatccttttactgtctccatagttttgcctcttccagaatgacaaatagttgagatcatactgtaggtagtcttttcagattggcttctttcacttagtaatagccacttaaagttcctccatgtcttttcatggcttgatagcacgtgtctttttaatactgaataatattccattgtctggatgtaccatagtttatttatccatcatctgctgaaggacatctttgtcacttccaagttctggcaattatgaatagagctgctgtaaacatttttgtacaggattttgtgtggacgtaagttttcaacacttttgtgtaaataccaaggagtgtgattcctgaactgtatagtaagagtatgtttagtttggtaagaagtggaaactgaaactgtcttccacaatggttatactattttgcagtcccaccagcaacaaatgagagttcctattgttccacttcctcatcagcatttattgttgtcatcagtgttttggattttggccattctaatagttatgtagtggttttaatcttgttgtaatttgcagttccctaataaataacatatgatgttgaacatctttttataagcctcagatacttgagctttttttggtaaggtatttgttcaggtcttttgcccattttttaatcaagttgtttgtttccttattgttgagttttaaggttctttgcatattttggataatggtcctttatcagacgtgtctcttgaaaatattttcttccactctgtgtcttttcattcttctcagtgtctttttcaggacagaagtttttttattttaatgaagtccagcttatcaattctttctttcatggattgtgcctttggtgttatatcttgttttattttattagctaggacttccagtactattgaaaaggagtgatgagagagaatattcttgccttattcatgatcttagcaggaaaactagttgctcaccattaagtatggtgttagctgtatgttttttatagatgttctttgtcaagttagggaaattcccttctattcctggtttactgagagttcttatcataagtgagtgttggattttgtgaaatgctttttctgtatctattgatatgatcatgtgatttttcttctttaggttgttgatgtgatggattatgttgatatttgaatgttagaccaaacttgcatacctgggataaatcccatttggttgtgtataattgtttttattcattgttgcattcaaatttgctaatattttgttgaggatttttgtatctgtgttcatgagagatacttgtctgtagtttcctgttcctgtaatgtctttgcctgattttggtattagggtgatgctggcctcagaatgagttaggaagtatattctcttcttctatcttctgagagagattttagagaattagtatactttctccctgaaatgtttcctagaattgaacccatcctggcttgctgttttctgttttgaaaggttatttattattgattcaatttctcggttttggcagattatgtcttttaaggaattgatccatttcatttagattattgaatttgtgggcatagaattcataatattcctttattattcctttaacgttcataggatctataatgatgttcctgctttcatttctgacattagtagtttgtgtcttctttttttcttagttagcctggttagaggcttatcaattatattgatgatttcaaagagctagcttttggtttcatttatttcttttgtttactttctattttcagtttcatcgatttctgctctaattttcattatttcttttccactgcttactttggatttaatttgctgctctttttctagtttcccatggtggaagcttagattattaattttagatctttcttatttttaaatatatgcattcattgttatgaatttccctctaaacactgctttcactgtatcctgcaaattccattaagctgtattttaattttcatttaggtctaaaatattttaaaatttctcttgagatttcctctttgacctatgctttgtttagaattatgttgctgtatctccaagtattttgggatttttccagttattgttataaatttctagtttaattccattgtgacctgagaatggatattatatgatttttactcttttaagtttgttaagatgtgttttatgacccagaatgtggtttgttttggtgaatgtgctacgtaatcatgagtaaaatgtatattctgctgtcgttggatgaagtagtaaatacatgtcagttattttcagctagttgatggttacgttgaattccaattatgtccttactgattttctgcatgctggatctgttcattttgtgataaaggagtattgaagtatccaacttcaatagatgaattatggattcatctattattccttgcatttctatcagtttgtttgtttgtttgtttgtttttgagacagggtggagtgcagtggtgcaatctctactcactgcaacctctgtctcctggtttcaggtgattcttgtgcctcagccttctgagtgctgggactacaggtagatgccaccatgcctgactaatttttgtattttttggtagaaatagagtttcaccatgttggccatactggtcttgagctccttatcaggtgatccgcctgccttggcctcccaaagtgtaaggattacaggcgtgagccaccatgcctgattatctatcggtttttgccttatgtatttggtgctctgtcattaggtgcgtacacattaaggattggttatgttttcttggagaattgacacttttattatatgtaatgctcccctttatgcctgataattttccttgctctgacgccagctctctgtgaaactaacatagctatttctgctttcttttggttagtgttagcatgatatttattttttcatcccttacttttcatttatatcaatctttatattgaaagtagctttttgtagacaacatattgttgggttttcttttttgatccactctgacagtctctgccttttaatgggtgtattgagaccattgatgtttaaagtgattattgatacagttggattaatagctactgtatttgttactgttttctattcattgcccttgttttttgttcctctttttgtcttctactcttttttcctgccttttttttttttttaagacagggtcttgctctgttgcccaggctggtgtgcagtggtgcagtctcatctcactgcaacctccacctcctgggctgaagtgatcctcccaactcagcctcccaagtagctgggactgtaggtgtgtgccaccacacctggctgatttttttctttagtgtgtgtgtgtgtattttttttttttttttgaggcggtgtctcgctctgtcacccaggctggagtgcagtgggcaatctcggctcactgcaacctctgcctcctgggctcaagcagggctcgagcaattcccctgcctcagcctcccaagtagctgggattacaggtgcccgccaccatgcctggctaatttttgtatttttagtagagatggggtttcaccatgttggccaggctggtctggaactcctgacctcaagtgatccacctgcatcggcctcccaaagtgctgagattacaggtgtgagccatggcacctggccaatttgtgtgtgtgtgtgtgtgtgtgtgtgtgtgtgtgtgtgtgtgttttaatttaaaaagttttattttcatttcaggggcacatgtgcaggtttgttatataggtaaattgtgtgttgtggtttgatgtgccagattatttcatcacctgaggaataagcacagtacctaataggtagttttttgatcctcacctttttcctatctccaccctcacgtaggcccagtttttgttctcttctttatgtccatgtgtacttgatgtttagctcccacttggaagtaagaacatgcagtatttggttttctgttactgtattagttcacttaggataatggccaccagctccatccatgttgttgcaaaggacatgatctcattcttttttaaggctgtgtaatattccatggtatatacataccacattttttcctatctaatctactgttgatggacatgtaggttggttccatgcatttgctatcgtgaatagtgctgtgatgaacatatgcatgcatgtgtctttatgttagaatgatatatattctgggtatatacccaataatgggattgctgggtgaaaaggtagctctgttttaagttctttgagagatcgccaactgatttccacagtggctgaactaatttacattcccacctacagtgtataaacattccctttttttctgcagcttcactggcatctgttattttttgactttaacaatagccattctgactggtgcaagatggtatcacattgtggttttgatttgtatttctctaatgattaatgatggtgagcatttttcatgattgttgctgcatttatatcttcttttaaaaaaatgtctgttcatttcctttgcccattctttaatgggattgtttgtgttttgcttgttaatttaagttccttgtaaattctggatactagacctttgtcagatgcatagtttgcaaatattttcttccattctgtgagttgtctgtttactgtgttgatagtttcctttgctgtgcagaagctctttagtttaattaggttccatttgtcattttttgtttttgttgcatttccctttggcatctttgtcatgaaatcttttccagggcctatgttatctttcagggttatcttccagggtttttatagttttaggttttatgtttaagtatttagtccatcttaagttgatttttttgtatatggtgtaaggaaggggttcagtttcaatcttctgcatgtggctagctagttacctcggcaccatttattgaataaggagtcttttctccattgcttgtttttgttgactttgttgaagatcagatggtggtcggtgtgtggctttatgtctgggttctctattctggtccattggtctatgtgtctttttataaaagtaccatgctattttggttactgtagccttgtagtgtagttccaagtcaggtgatgtgataccttcagctttgttctttttgattaggattgccttggttgtttgggctcttttttttttgttccatatgaactctaacatagttttttctaattctatgaagaatgtcattgttagttgataatagcattgaacctgtaaattgctttgggcagtatggtcattttaataatattgattcttcctgtccatgagcatggattttttttttccatttgtttgtgtcaattgttatttctttcagcagtgtttttcaattcttgttgtagagatcttttatctccctggttagctgtattcctaggtatttgtgtgtgtgtgtgtgtgtgtgtgtgtgtgtgtgtgtgtgtctgtctgtcttttgtaaatgggattgcattcttgatgtggcgctcagcttggatgttgttggtgtatagaaatgcttctgattgttatatattgatactgtatcctgaaacttcgttgaagttatttatcacatctaggagtttttgggcagaaactttggggttttctagatataaaatcatattgtctgcaaatagagagagtttgacttcccctcttccaatggaatgccttttatttctttctcttgcctgatttctctggctaagacttccagtaatatattgaataggagtgatgagagtgggcatccttgtcttgttctagttctcaagggtatgcttccagcttttgcccattcaggattatgttggctgtgggtttgtcgtagatggcccttattattttgaggaaaattattccatgcctagtttattgagggtttttttcaaacatgaaggatattgattgttatcaaaagccttttctgcatctattgagataatcatgtggtttttgtttttacccctctttttgtgatagatcacatttattgatgtgtgaatgtaagaccagccttacatcccagcgataaagcctacttgattgtggtagattaaatttttgatgtgctgctggatttagtttgctagtattttgttgaggattttgtatctgtgttcatcaaggatattggcctgaagctttttttgtttggtttctgtttgtgtgtctctgccaagttttgggatcagaatgatgctggcctcgtagaatgagttagggaggagttccttctcaattttttggaatagtttcagtaggaatggtacaacctcttctttatatgtctggtagaatttggctgtgaatctttctggtgttggactttttctggttgctagtctttttattactgattgaatttcagaactcgtttttggtctgttcagggttccagtttcttcctagttcaatcttaggaggttgtactttccaggaatgtatctatttcttgtaggttttctagtttgtgtgcatagaagtgtttgcaagagtctctgagttttttgtttttttttttctgtggattcagtggtaatatcttctttatcatttctgattgtattcatttggatcttctctttttttttcttagtctagcagtggcctatcaatctaatttattctttcatagaaccaacttctggtttcattgatcttttgtgttttttttccttctcggttatatttagttcagctctgattttggttatttcctgtcttctgctagctttggggttgatttgcttttgtttttctagttcttctaggtgtaatgttaggttgttaatttgagatctatttttttgatgtgggcagttagtgctataaactttcatcttaacactgctttagctatgccccagagattctggtatgttgtattaatttcttgatttctgacttaatttcatgtttatccagaagtcattcaggagcaggttatttaatttttatgtagttgtatggtgatatggtttagctctgtgtcctcagccaaatctcatcccaaattgtaatccccacatgtagagggagggacctggtgggaggtgactggatcatggggatggtttctcccatgctgttcttgtgatagtgagggagttctcatgagatctgatggttttaaaagtggcagtttcccctgcacactttctctcctgctgccatgtaagatgtgccttgcttccccttcactttctgtcataattgtaagtttcctgaggcctacccagtcatgtggagctataagtcaattaaacctcctttgtttatacgttacccagtctcaggtagtatcgttatagtggagtgagaacagactaatacaaatggttttgagtgatcttcttagtgttaatttctgtttttattgtgttgtgggtccaagggtggttggtattattttggtttttttgaatttgttgagaattgttttatggctgattgtgtggtcaattttagagtatgtgccatgtgaagatgaaaagaatgtctattctgttttttttgttgttgagacttctgtggatgtctgttaggtctacttgtccaagtgttgagttcagctcctgaatgtctttgttagttttttgccctgatgatctgtctaatactgtcagtgggtgttgaagtttcttgctattattgtgtcattatctaagtctctttgtaggtctccaataacttgttttatgaatctgggtgcttctttgttaggtgtatatatacttagtataattaaattttcttgttgaattaaaccctttaccagtatgtaatgctcttttgtgtccgttacataatgctcttgtctttttatatttttatttttaatttttgtgggtacacagtaggtatacatattcccagggcacataagatgccatgatataggcatgcaatgcctgtatcaaaaaagcacatcatggagattggggcatctttccctacaaggacccccttatctgcgttacaaacaatcttaactacattccttaagccatttaaaaatgtacaatcaggttatcatagaccaaaatcaccctattgtgctatcagacaataggtcttattcattctttctattttttttgtacccctgaaccatccccacttctcctccagcccctcactacccttctcagcctctggtgaccatccttctactctctatgtccatgagttcaattgttttaatttttagacaccacaaataactgagaacatgtgatatttgtctttttgtgcctggcttatttcatgtcacttaacatgatgacttccagttccatccttgtagttgcaaatgactggattttattcttttttatggctgaatagtactccattgtgtacacgtaccacattttctttatccattcatctgttgatggacacttatgttgcttccaaatgttagctattgtaaatagtgctgcttcaaacataggagtgcaaatatctctttggtatactgattttctttcttttgggtgtatacccagaaatgggattgctggatcatatggtagctcaatttttagttttttgaggaacctccaaactgttctccatagtgttgtgctaatttacattccatgaacagcgtatgaaggttcccttttctctacatccttgtcagcatttgttattgtctattttttcatataagccatttaactggggtgagatgatatctcattgtagttttgattagcatttctctgatgatcagtgatgttcatttgcctgttggaatttgtatgtcttcttttgagaaatgtctgttcaagtcttttgcccattttcgatgggattattagtattttttctatagagttgtttgagctccttacatagtcttgttattaatcacttatcagatgggtagcttgcaaatattttctcccattctgtgggttgtctcttcactgtttcctttgctgtgtggaagctttttaacttgatgtgatcccagttttccattttgctttggttgtttatgcttttagggtattgctctttgtcttttctgattgttgttggtttaaagtctgttttgtttaaaattagaatagcaatctctgcttctttttgttttgtgtttgcttagtagatttttctccatccctttacttttagtctacggatgtcattttatgtgaaatgggtaggtatcttgaagacggtatacagttggttcttacttctttatccgacttcgtactctgtgccttttaactgagacgtttaacccatttacattcaaggttaatactgacgtgtggatttgatcctgtcaccatgttgttagctggttattatgcagacttgattttgtagttgctttatagtgtcaatagtctgtgtacttaagtgtgtttttgttgtgaccagtaatggtttttcatttctgtatttagcactcccttaaggacctcttgtaaggctggtctggtggtaacaaattcctttagcatttgcttatttgaaaagggtcttatttcttctttgcgtatgatgcatagtttggctggatataaaactcttggttgaagtttcttttctttaagaatactatattttggcccccagtctcttctggcttagacagtatttgctgacaggtatgctgttagtctggtggagttccctttgtaggtgacctgccccttctctctggctgtctttaatattatttattttatgttgatctgggtgaatgtgatgactgtgtatcttggggatgattgtctcatatagtatctaacaggggttctatgtatttcctgaatttgaatgttggtctgtctagtgaggttagggaaatttttgtgaagtgaatgatatccttaaatatatttttcaaggtgtttactttctcactctttctttcagggatgcccatgagtcatagatttggtcccttcacataatcccatatttgttggaggtttcattcattctttgttttttttttttttttttttttttttttttttttttttgtctgactgggttaattcagagaatcagtgttcaggctctgagattctttcctcagcttggttaattctgctgttaatacttgttatgatatcgtgaaattcttgttgtgagttttttagctctatcagatgagtttggttatttcttaagatgaccattttatcctttggcttctgtgttattttattgtattcctcagattccattgattgagtttcaactttctcctgaatctccacgatctttgttcctatccattttcagaattctatgtctgtcatttcagccatttcatcctagttaaggaccattgctggggaacttgtgtggttgtttggaggtaagaagacactctagctttttgaactgccagagttcttgtgctgtttctttctcatctgtgtgggctgatattcctttaatctttgaaattgctgtcctctggatgagtttttttgcttttatcttctttgctgccattgggggtttgattgtggtctaaagtgggttcagttgactaggttcagttgactactatgctgtgtgctctaattctgtggggctggtatggggcccccagctttgttccttgacacctttgtgttaggaacctggtgtgctgaaggggccaaggtgttcccggtccactgacctcagtactctgatggggggtgccagccaacacctttcctcagggccgtggcagtgggatccatgctggcttgtgtgtgccagaagctgcagtggcgcagtggggtgcacatgtgttggttggggtggggtgccagtaggagcctttgcattaagttttcataggcactatatcctggcaaaatattttaccattgtattttgggctgtgagccagtaggcaccatttaagaatgttagccagcagataggctcttaccgtactgcaaagcttttttgttttagcacagtgggtaggagtgctctatgttgggggttagagagatgactcccttacctagtttgttccggtgccttggaggaggcccctccaatcactggctctgtgcttgcatttcttttgttaggagttctggttcatgaggatccctcaggcaggggccacggttggcacataggccatatccttgctgtttcctgtggagggaggcacactccggtcctccaccagcctgtgaacccaggcatcttctctcactgacctgaaagtgagggctcctccctgcttgggtacagcaaacaagcaagctctccttggctaggagccgtgagggtgagtgaggtcacctaatgttctgtctgggtgcttcctgggggaatatggggttgtgcctgcctgcagagttcagacagaagtgggaccattctgctggaagctctagcatgcctggcccctctgcctaccagtggtggaggtgggtggagatgcctgccctgctgtccgggtgttatcctggggcaaaaggatattgtgccccttggcagaattcagatagaagaaggaccagtggactggaagctctagcaggcatggcctgcctggctaccggctttgggggtgggtggagtggcctcccctgctgtccaggtgtttcccaggacaacaggaggttaagtctgcctgctgagttcaggcagaagcaggactgctgggttggaagctctagcaggcgtggcccacctggctatgagccgactgggagagtggagtcaccttccctgccgtctgggtgtttcccagtacagcaggaggctgtggctgctggctgacttcaggcagaaacaggaccactgggcgggaagttggcactgagccttgtctatcaagggcggggtgagggcggctggagcaatcttattgcttccaggcaccctgactgtggcctctactggggttatgtcactggtgccagttttttctggggtccaaggcttgtataggtgtccttggacttgagagttgcctctggaaaatctccaggtggctctctgcttcagtttagaagcatggttgggtgtgcaggggcctagaaggattctcccattcccagtcctgcacaggtccttgtggaaagtgtgaatcccctgaggggctctcactcaccactcccttgttggggagcttctcatgggtctgtgttgactccagataggctcctgcgcagcttcactcctctttgctctctgtgtccccttgctgccttgatggatcccggagtagtttcatggatgatcagcttgtaggatcagtgttcagtttgtttccctcttcagtttcttgcatcaatgttttgtagttttcattgtagagatctttcactgcttgggttaattcctaggtattttattttatttgtagctattgtaattgggattactttcttgatttctttttcaaattgttcactattagcatatagaaatgttactgatttccatatgttgatttttatatcctgcaactttactgaatttgttttattagttctaatagttttttggtggagtttttaggtttttccaaaaataagatcatatcatctgcaaacaaggataatttgacttcttccttttcaattcggatgccctttatttctttctcttgtctgattgctctagctagaactcccagtactatgttaaataacagtataaaagtgggcctccttgtcttgttccagatcttttccccattcatcatgatactagtgtgggtctatcatacagactttttggcttttattgtactcaggtatgtttttttctatacccagttgtttgagtgctttttttcatgaagggatgttgaattttatcaaatgttttttcagcaccaattgaaatgatcacatggtttttgtccttcattctgttgatatgatgtatcacattgatttgcatatgttgaaccatccttgcaaccccgggataagtcccacttggtcatgatgaatgatctttttaatgttttgttgaatttggtttgttagtattttgtctaggatttttgcattaatgtttattaaggatattggcctgtagtttttttttaattttttttttttttttgcatgtgtctttggttttggtatcatataccagcttcatagaacgagttttagaagtattccctcctcctctatcttttggaatagtttgagtaggattggtattagttcttctttaaatgtttggtaaaattcagcagtgaagccactgcgtcctgggcttttccttcctgggagactttttattacagcgttgatatcattactcagtctgttcaggttttgaatttcttcatgattcaatcttggtaggttgtatgtgtctgggagttgatccatttctcctaggttttctaatttattggcatatagttgctcatactagcctctaatcctttgaatttctgtgttatcaattgttatgtagtttttttcatctttgattttatttatttgggtctcctcttttttcttagtttggtcagagatttattgattttgtttatcttttcaagaaaccaacttttcatttcattgatcttttatatatatatttttttcatttaaatttcatttatttctgctctgatctttattatttcttttgttctactaattttgggtttagtttgctcttgctttctaggtctttatgatgcagcattaggttgtttatttaaagtttttctacttttttgatgtgctcatagctataaattttccttttagtactgcttttgctgtatcccataggtatagtatgttgtatttccattatcattgtttcaataatttaaaaaaattccttcttaacttattcattggccctctgatcgttcaggagcataatgtttaatttccatgtgtttgtatagtttccaaaattccttttgaattgatttctggttttattctattgtgttcagagaaaatacttaatataatttcagttttaagagttgttttgtggcataagatacggttcatccttgagaatggtccatgagctgaggagaagaatgtatattctgtagccactggatgaaatgttctgtaaatatccgttaggtccatttggtctattgtgtagattaagtccatgatttctttgttgatattctgtctggatgatgtgtctgttgctgaaagtgtgcagtgttaaagttttcagctattattttgttagggtctatctctctgtttagctctactaatatttgctttatatatctgggtgctccaaagttggatgcatatatgcttacaatcgttatattctcttgctttatatccctatataatgacttttcttttctctttttataatatttgtcttgaaatctattttgtctgatacaagtataactatttctcctctattttggtttccattggtatggaatatctttttccatctctttattttcagtctgtgtctttgtagatgaagtgtgtttcttataggcaacatactgttagtttttttaaatgcatttaaccactctttgtcttttgatggagagtttagtccatttacattcagtgttgttattgttaagtaaggacttactcttacaattttgttatttgttttctggccttctcttctttcttttctttctgttttcgttttagtgaaggcagttttctctgttggtatgttgtaatttctcactttttattttttgtgtatctgttgcatgtttttagatttgaggtaactatgaggcttgcagatactgtcttataaacattattttaaactgatgacaacctaacactgattgcataaagaaacttataccaacaaacaagtaaaaagaaaactaataactttaactttcaagcaagtaaaaagaaagctaataactttatctacctgctttttaactttttgtagtttctatttatatcttactgtactgtgtatttcttgaaaagttgtagttattatttttgactagttcatcttctttcttctgaaaatattagtagtttacataccacaattacagtgttataacattctatgtacttaatattactaatgagttttgtaccttcagatgatttcatattgctccttaatgtccttttctttcagattgaaggactccgttttagcacttcttacaggaccagtctggtgttgatgaaatcagcttttgtttttctgggaaagtctttatttctccttcatgtttgaaggatatttttgccatagatactcttctagggtaatagtgattttctttcaggactttaaatatgtccatgacactctctcctggcctgtaaggtttccagtgaaaagcctgctgccagatgtattgcgctccattgtatgttacttgtttcttttctcttgctgcttttaggatcttttctttatccttggtctttgggaatttgattattcaatgctttgaggtcatctttgggttaaatctgcttggtgttctgtaaccttcttgtacttgaatatggatatttttctctaggtttgggaaatttctctgttattattcctttgagtaaactttctaccccagtctctctctctacctcctctttaaggtcagtaactcttagatttgccccattgcggccattttctagatcttttaggtgtgcttcattctttaattgtgtatttttgttgtttagtataacttataatttttcttggtagctggatatgttgtacttggtattggttcccatgaaggtttctgctcaggtgtttctgttccagtaaattgtatttctatgtatttgcctgtctgtttgtccaattttggggcagctttgtgatctcacttttgctttgttacctcacttttctgatggatctatgcagagttgatgatttttcagtttgttcagctttttacttgttaagatggaatgatgacttccaagctccttacatgcaggactggaaagtagaagctcacattttatttttagaacaataaaactacaaacataagctctctgatatggtttggccatgtccccacccaaatctcaccttgaattgtagctctcataattcccatgtgtcatgagagggacctggtggaaggtagttgaatcatgggggcgagtttttcctgtgctgttctcatgatagtgaaaaagtctcacaagatctgatggttttagaaagggaagttcctctgcacatgctttcatgcctgctgccatgtaagacgtgcttttgctcctcctttgcctccccagtcatgtggaactgtgagtccattaaacctgttttataaattatccagtcttgagtatttcttaatagcagtatgaaaatggactaatacagtaaatcggtaccagtagagtggggtgctgctctaaagatacccgaaaatgtggaagcaactttggaattgggtaacaggcaaaggttggaacagtttggagggctcagaagacaggaaaatgtgggaaagtttggaacttcctagagacttgttgaatggctttgaccaaaatgctaatagtgatagagacaataaagtccaggctgaggtggtctcagatagagatgaggaacttgttgggagctggagcaaaggtgattcttgttacacttaaaaaagagactggtggcattttgcttttgccctagagatctgtggaactttgagcttgagagagatgatttggggtatctggtggaagaaacttctaagtggcaaactgttcaagaggaggcagaatataaaagtttggaaaatttgcagcctgatgatgaagtagaaaagaaaaaccaattttctggggagaaactcaagcctgctgcagaaatttgtgtaagtaacaaggagcccaagacagtgggcttaatcaccaagacagttaatcaccaagttaatcaccaagacagtggggaaaatgtctccaggacatgtcagagactttcatggcagctcctcccatcacaggtctggagggaaaaatggtttcttgggctaggtccaggactcccctgctgtatgcaggctaaggacttggtgccttgagctccagtgctccagctgtggctgaaaagggtcaagatacagctcgggccgtggcttcagagggtgcaagccccgagccttggcagcttccacatgatgttgagcctgtgggtgcacagaagtcaagaattgaggtttgggaacctccgcctagatttcaaaggatgtatggaaatgcctggatgtccaggaagaagtttgctgcaggggcagggccctcatggagaacctctgttacggcagtgcagaagggaaatgtggggttggagcccccacacagagtcaccactggggcattgcctagtggagctgtgagaagagggccactgttctccagaccccagaatggtagatccaccaacagcttgcaccatgtgcctggaaaagctgcagacactcaatgtcagctcatgaaagcagccaggagtggtgctctatcctgcaaagccacaggggtggagctgcccatggctgtgggagcccatctcttgtatcagtgtgacctggatgtgaaacagagtcaaaggagatcattttggaacttcaaggtttaaagactgtcctgttggatttcagacttgcatggagcattgtaggccctttgttttggctaatttctcccatttgaaatgggtgtatttacccaatgcctgtaccctcattgtatctaggaagtaactaatttgcttgtgattttacaggctcataggtagaagggacttgccttgtctcagatgagactttggactgtggacttttgagttaatgctgaaatgagttaagacttcgggggactgttgggaaggcatgattggctttgaaacatgaggacatgagatttgggaggggccaggggtggaatgatatggtttgtctgtgtccccacccaagtcgtatcttgaattgtaactcccaataatccccttgtgtcgtaggagggacctggtgggaagtaattgaatcacaggggcaggattttcctgtgctgttctcgtgatagtgaataagtctcaggagatctgatggttttataaagggcagttcccctgcacacactctcatgcctgacgccatgtaaaatgtgcctttgctcctcctttgccctctgccatgattgtgaggcctccccagccatgtggaactgtaagtcaattaaacctctttctctttatagatggcccagtcttgggtgtttcttcatagcagtatgaaaatggactaatacattctctaaagcatcctctgataatcctttcttttattcaagtcttaagttagatctttggaacataaagccagattgttaaaactgtactgcataattttcatctaagacacttgttttaaggcattttttcccattgggagggttttgagattatgaagatgacactgtacatttgtaatgttttcaactttttggagcactcaagggaggtcccccaagaacactctttaagaatgactttttttggaaattacctaccgtgtgataaggtgtcagggatagagtggctccacacacagcttagagttttgacagcacaagactgtctgtttccactttattgctagtgatcatctcattcgacttctgatactacaagtggttttggccaagtctctctttttttccatctgaataaatttctgcttttcctttcatctttccttctgatagttttcatcacccagcttgctagtaaaacacatggctttaaagggccatctgatcttgtgaaatctcctttcctgatggtttttcaaaaataggagagcaatctctctggcatgttttaactcagctgcacctgtagcagcagcttgacctggacctgtggggtcaggacgagagaactgaaactcagactcccattttatagaggagataagtaaagctcaaaagaaaagaagtgactttccagtttctgtgggctctgattgcccttttgtacaaaaagagtgaaaaacaattctgggccaggcgcggtggctcacgcctgtaatcccagcactttggaggccgaggcggatggatcacctgaggtcaggagttcgagaccagcctggccaacatggtgaaaccccatctctactaaaaatacaaaaaaaaaaaaaagttagctgggcgtggtggcgcacgcctgtaatcccagctacttagaaagctgaggcaggagaatcgcttgaacccaggaggcggaggtcgcagtgagctgagattgcgccactgaactccagcctgggcgagaagagtgagactctgtttcaaaaaaacaaaacaaaacaaaacaaaacaaaaccagttatggtcattttttctctagggcttgataacatgtaagacaaattttaaatttacttgaaagaaagtgctatgtagatattgactatcattagacttatattttggataaggtatctcattttaatattgctaaactaggatcgatataactactagtattaaaaacatagaaggtcaaatctgttttcccccggaacacaggagaacaccctacttttgaacaagtgatgtcccattagatctttatcaattggtgggttggaacatgggttttcctttgctgagtgacatggtactgtctactgagctcttgatgttgccaggctctgggctgacagctctacatggattacttcaggtaatcgctacagtaagcccatgattggctatcattttaacctccattttatcgatgaggaaactgaggtttagagaggataaattctcacagcaggagtcaggcccaaagacagcactcttctgtctcctagaggagctcagtacaaagcccacagatagtgcttgccctagtttagagcccagctaccaagcctggagatgtgtctaagggacaatgagccctctgacctggctgctgagagtctggatttcccagactacagatgaatcaaatgcagtcatctgtgtttacaaactcacctaattgatccaacagggttagaaatacatgagagattcatttgttcattgattcaaataatatttattgagtacctaccatgtagtaggtacatgtcaacatggaagatgttgaggggtggcagcgggcactctcagtgatggatggggccctgtgtaaccctccaggaagcttcttggttttacatttgctcctttttaaccccttcttttcttctggaaacctcagggaagatctgagtgttccttcaccccttctgtatctggcttctgattggcttctttcctcccttctcacacctataagcttctctgcctgtctgtttctgaaggaaggacatcgcttatttgagggtttctaagggtgtttttttcctatcaattgcaagtacaaaaaatgttccttttatctctcctgtgcctagtacatggtaagtattcaataaatatttctttgaatgaatgaacaaataaatctctcgtgtctttctgaccctgttggatcaattagatgagtgttgtaaacatagatgattacatttgattcatctttagtctgggaaatccgggctcttagcagccagggcagaggaccagtccaggactcctaggatgatgttggtgaggagatggatggactagaggtgaatgcagaggcagccggggctgaggggaatggatgtgtgcaaggtgtggtgggagagggcgtggtggacttagaggcagtggtgtgcaggcagatcctttggttgtaagtggatgatacacagactgacttaaataaaagaggttgtttattggcaggtaactgggaatcctaaggtttatgctgacattaagcctgattggctctccaggggttcaaatggtgataccgtgacctgaaccggctacatcatttgcagggctcagtgcacaaggaagatgtgggatctcttgtgaaaacaaaaacagaaacaaacaaatttcaagatgatgacagcagaaagttaaatcaagcacagggcccttctaagcacagcacctgtgggactgcacagattgcagtctcatgaagctggccctgatcaggatcctgtctctctcaacaagtctcagccctggtgatctccgtttgtcttcattctcagatggattttctccatgtgacatcaaaatgacaccaacaactccaaaccttcatcgtctttagatctaatgatctcagagtaaggcaaaattctgaacctgttttcagagctttagtgacagtcccagagagaactctgatgggtgattggccaagattgggtcatgttcccatccctgaaccaatcacctggccagtggtttgtgttgctctgattggctagggttgtggcgatgggggtgtgatgggaaggcagggctagccccatgtagctcttatggactgtgggtgcattgtggaatgggaggggaaggtcccccaaggaagggatgctggatggacagaaagttagatcagcatcagctatagctggggaggtaggagacggaaaagtagccccacatcacccatcttgtgatgagagcaagtgggtatgtgattggatggggtgggtatagttgcagaagatgtggtttctgacaacagatagttgaatgagtatagaaaaaggggaacggtgaagtggggatgatatcttagggtgggggcagatggagaggaaggaatagaagacccttgggacttctggcctataggttagggtggctgtccttgcttgctgttcatgtattgagggggttgcatcagctgggccagcctttagtcactctgggccaggttttaggaattctcgtagttagtgaggagatgagaagcaggaagctttccatcagtttcctgcctctgggaggtagaagtagctctggagccatttccctgccacccactttgtgatcttgggcaattatattacccaaaacttagcttcagttttgtcatctgtatgtgagaatcttataattccctaatagttagtgggaacttgtaagatgcttggtctaatatctaaagtaggtgcttaggaaatacacactgttgttattgttaatattggtttcagggctttcaggaaacaaaggtcactgctgtgccacatccatgcattacatactcctccagaatacctctagccatatttacaatggagaactagaataatggttccctgaaagataccagctcctaatgcctggagcctatgaatgataccttatggcacaaatactttgaagatgtgattaggttaaggatcctgagatgaggaggttttcctggattatccaggtagttttataaggcatccttttaagagagatagagatttgatgtacccacagaggtggtaaaggcattgtgaagatggaggcaaagattgaagtgtcacagccacaagccaaagaatgctggcagacacctatagtgtacctggaagaagcaaggaacagcttctccctagggatattcagagggattgtggccctggtgaaaccttgatttcatcccagtaatatggattttggacttctaagcctccagaactgcgagagaataagtttctgttgtttaaagccaatcagtttatcataaattcttaaaacagccacaggaaaattgtacactcttttgaggtggacctttgttatttgctttggttctcgtgtttagcatgatattgcacctgctacagttttctggtttaaactctggggagtcaggtgagactttcaagatggcagtagcccatgccatttctaccacactgagctcctaaagagccataggaaccctaggattcaggttatatggagccagctctttaattctgagataatcagctaatggtgcagttactacctgagatgatgtatttcattgggaaatctctagactaaatgaggcacgagtaatttttaagttttagaagaacaataatctattcttagagttcacacctcatggaaattgttggttgaatatgagtaacaagcacgagacttatttcctcaattccccagtatttagaagtgtgaacgcccttcaggatcagcctttcccaccttccacatgctgcagaggtccactaagcagaggtccacaccctcatctgagaatttactgaatgctgcagtgatgttaacattgtttgttctgcctttcttgataggaatgtaattatccatataggattaagaataaacaaaatggcacttgagtagttatatcctgtctttgttttgggtaatattgcataatttatcctaaatgcttagacctctttttttttctatttctcagaacagaatttaatatttttgtgccactatcaaactttgaattccaaaatgacggcacattttggaccaagattcagacgataagttcattccagaaaggtggtgtttggccttgaaatgatgacaacaaagcattggaacattgctataacggagtcccttattgaactctgatattcttctcagaaatccatgttagaagacaattttaaaataaggatataattatgactcagacagatataaaatgaacatgtgtgagattttaacttattaattaatgtgggaaccagtgaggtgtttcaacacattcaaaggaatgccgaaatgaatttataaatagatgcaaaatgggtttatccatagggcaataaccacattggattccaaagatacaattaatttccattttatagtcacaaatcatttgcataattatcagttttctacatcttacatggtgtatattactcaaaggtaatgaaaggcagaggtaacttggaagggtgagttagacctttttttgggtctgtttcaaagtgttttacagtttttccagtatatgctttactctgacccgtggatcaaattctacttggaatagcactgtggtaatgtggacaaggaaaagcccagggacagagtgtgccagtcatagaggtgtctggggaacaagtccctttctcctttcagtgcagggacttgtcagttgtatagattctgaggaaccagttgcattgtagacatgccatcatcaaggactgtgtgcttacctttgaaagatcaaatagtgtaatggtcaagggagcgaacttgggttcacattttagctctgccacttactagctatatgacctctctgtgccttagcatcctcattggtaaatgggggtaatatggtacctacggcaaaggtagtaggtaactaaatacattaatatctgtgaggcagtagaccagaatctggcatttacctagcactaggtagttgttagctattattaatttccaagcaaataatagcacctgtaatttcagctacttggaaggctgaggtgggaggaccgcttgagcccaggagtttgaggctgcagtgggctatggtcatgccactgtgctccagcctgggtgacagagcaagacccagtctttaaaaaaggaatagcggcaaccaagtgtaagtcctgcatttcaccatttcgggagctgctttatgatctgatgcttattgtactctatcgatattccatgcatacgcaattgacagaggcctctggccaataagctcgtaaactctcttgtctactggatatcgtcatggtctctgggcattttgcaggactggggcacttctagagctcacatttaattttcagatgtcaacatagtgatgactttatctcaaattacatggaagcaaagcgtagggtattaatttttttaatgtaatgttagttgcattaacttttctgtaaagtactaatggagttccatgtaaaatgcacttagaaacacactgggtgagtttcacaaaacttcagactgttgggttggagtcatattattctttagtatttacttacgttgtttacatgaaaactgatttcagagtgactgtacctgggtgattaaccacattttcataaatttggatgcttttcatatagtttctaatgaatgtttgataaactgttaaataaatgagtatgtgtgtgtgggagcaatcttcagattacctgttttgcacagtagtgcaaaacagctgtgtggggaaaagttatatgtgtcattagtaatttttatgactcagttcggtattatgagtctacctgtctgcacagcattttcatcttggtgggagaaaattgacacatcatggtggatgtaaaagttttccatgaagaaattactcagttcctttgactgtgtaggctgttggatgctgtcttttctctggacaagcatgtggcattggctctcagtggacagttcatctctcacagataaacagtttaccttccaagattataatagctactccccctggctcaaagtaggattacacagttaatagagagagctgtagcaaagtttggaaagtgtaatgacaacattatggcttgaggagaagaaagtgccgattttcctttgtttgagtttgttactcattttgctttttatctcatataactttttgcaaaaagttacgaaacagaagatatgatcttatatgtttctcttttaataaatatttgcccgcattaatacctgcaactacagaggattcaagccagtacattttaaaaatggatcttaggtggccagaattggattaatcatactttttggctcattacacactattgttcttacttgtaaataaactgtcatgattctaatgacttgaatactttttcttgaaatatagttgtttaacttttccctaaatttggcaaaataattgctgtctgaactatctaaatataaagctagctttggacaggtttggaacatgttttaaaaatcacacataggctttcatgataaaaataagggtttgagatcagaggatgaactcatggacttctttgaccttttattcttgcggaacttcacagttgagtgatacattgatgcttggttaagtgacatgggtaaagtttcggtcaactgttttcagttgttgtaacatgacagaacatgctagccatcttcagtgggcgtcctcaaaacagagagggatggctttagaattctgtttggaaatgacctaggaagtcagtcatctaatctagctcctccagccctgttgcaacccaggagtcctctgggtgcctctgccacaggcaacttagcctgcacttgaatctttgtagggacaaaaaactcactccctcatgaccaatccttttctttcagagacaactttaatgattaaaaatgaaattggttttgttgagcttaaatgtgattccttaacacttctactcatttgctggtattattggtctccacttgtagatgacacaaaaacagtcctcctgcttatagggaattctttgttgcatataaattctgacttttgtcagaatttgtgttttctcagtgtgcttctctccgataagatcttacgatatctgctcaattcaacaagttgagaatcagttacatgcaaggcactgtactgtcctcagtgcctgggtgggagaggtagggacacaagatgacttggttcctgccatccaaatgtatgctgccacgtgaaatgcattggaaaagcacacagattgatacaacagagaaacccaatgccattggggttcaaaggagaaagagtgatatcaaactcagctgtgctagaagagcttcagcatcaggagggaagggagataggcaggtaggatatttttgcaggttgagacgggagaagggcattccaggaagaaaccagtgtggacaaaagcccagggatgggaaacatgagtttgtccaaaagaaggggagtatcttatttgctcagcatgtaggatgcttgcagagaaatgaaggattagatggtaggttgatcccagagctcagacaggcttgatctctctgcctcagttatttgtgttttggtactaggattccattgcaggagcacagacctggatttggatccaagtattgccacagagcttcggcatcttagtctgaaaatggagatttgtgtccattctaaggattccaggacatgtaagggaagaatccagcactctgcctggtacacagcagaggagatcagtgacagttgttattgctgaatgtgataggcctcaggaggagatcctgcagggggttcagggtggcgcatggaggaagacctgtgagagatgctcctccagcgggaagggaaggtgtgcgtggcagtgctggagtgggagtagggagtgggaaacagggctggcatcagtggggaagctggagtcggcagaactggaagcagatttaatgtactgggcaggaggaagaggagaagtcaccccaagtttttgttggggaaggagggttaggcaagaatggtgagtttggtatcgggtgcgttgaggtgctggtgggcctgcagatggagagagcccacagcagctggcagcggggggatgctgggccttaggagtgagccagggaggtggaaaatgcagcatgaggagggtcaggatccaaacggtgtgctaggaatgcaggcacgtgcaagcaagggagggtccttgatcatgtagagcctgcactttggcgtgggtatgtggaaagcagccagcacccaaccagggctggcgtaaaagcaaagaaaggaaagaattcaagagacatggggaagggaaaattggtggagacagcctgacagatgattcccagtatcttagagttctcaggaaaaaacggaaaacaatcttcacattgtttttatacacacacatatgcacacacactctctctctctcatatatacaagttcaatccaaacaccatctattatttggtcctgttagtttcctcagaaagaccctcaggaaatccttgctctcccagagattgtgtctatgtttagaagacttttagaaaaagcctattgttaaattttagtttactgggtagtcactaggagaccatagaaatgtaacccacaggttggctgtattgagtgggcttttgttttactgaaggccgtgtggggaaaacaggactccgtctttggtgagtggctcttcctggtactgtgaacccagggaacccaagaagggaagcgctgggggtcagggatcacctggcctgacccccttgtgtaacagatgaggaaactgaggcctaggccattggaaccagctcagggtcacatggcacatggctcatttgaggcagagcctgtggcttgatgttgggcattcctgctacttgaagttacctgtttatcccaggccgggacctctgggctcatttacaagtggatggcccaaagaggggacttcagttaggggagtgtgtgtgtgtgtgtgtgtgtgtgtgtgtgtgtgtgtgttgggggttattcagggaccattcattacagagcttgactgtgggaaagagtagtcagatccaagtgattattgtagtgccctcgtcatttattagcagatctttctaagaagtgtcctacagaggagagtgctaaaacataaagggtgaaacccttgtcatcagaggtctttacgtagaacctaaatatccacccactcgagttagcaagagttaacattcactgaggactgatggtgtgcctggcactaagtgtgttttctatggaatgtgtctcatttcatcctcttagtgtctttatgagataggtactattattatgctaattttacagatcaggaaactgaggcaccaagggattaagtaacctgcccaaggtgacacagccagtaagtggtagaaccaagattataccatctgttaacctcagagtctgcacgcttatctaatattagtgagtcttttttttttttttgagatagagtttcgctcttgttgcccaggctggagtgcagtggtgcgatctcggctcacagcaacctctgcctctcaggttcaagcgattctcctgcctcagcctcccaagtagctgggattacaggcatgtgccaccatgcctggataatttttgtatttttaatagagacggggtttctccatgttgatcaggctgttctcgaactcctgacctcagatgatccacccacctcgccctcccaaagtgctgggattacaggcgtgagccaccgcgcctggccacattagtgattcttaaccttgctgcgtataagaatctcttgggaaaattaagaaaaattccagttctcaggctacatcccaaaccaattgaatgaaactcatgggagatcttgcattggtattttcttttaaagctcttcagctgggcttggtggcttatgcctataaccccaataactcaggaggctgaggtgggaagattgcttgaggtcagaagttcaagaccaacctggacaacgcagagaaaccccatcttttaaaaaatacttagctaggtgtggtagtacgtgcctgtagtctcagctgcttgggaggctaaggtaagaggatcacttgagctgagaagtttaaagctgcagtgagctatgatcacaccattgcactccagcctggcaacagtgtgagaccctgtctccaaaaaaaaaaaccgctcttcagatgactgttactcatagcgaggttgaaaaccaccagagtgctccacagccggtggagatgttatagggcagtgcctctcgaactaatgtgcataggaatctcctgggggtcaagtgcacattctgacctagaaaacctggggtggagcttagagtctgcatttctcacacgtgtccaggtgatgctgtgctactggtctttgacttttctgtcttggttgaaggctaatcattgtggttgtgtccaactccaggatttaatggctctagtgatacttataagaacacatgatttggccgggcgcggtggctcacgcctgtaatcccaagactttgggaggccgaggcaggcggatcacgaggtcaggagatcgagaccatcctagctaacatggtgaaaccccatctctactaaaaatacaaaaacaaaaaaaattagccgggcgtggtggcgggcacctgtagtcccagctactcaggaggctgaggtgggagaatggcgtgaatccaggaggccaagcctgcagtgagccaagattgcgccactgcactccagcctgggcaacagagcgagactctgtctcaaaacaaacaaacaaacaaaaacaccacatgattttactgtgtgtcagcctaagaacattacatacattatctcttgccctctcagcagcctctaaaggaggtatcattttccctgttttatagatgaggaaatcgaggtctattgagtttaaccctagtcctaacctgagtcttcgtaatcttacacctgtgggattaactaccatgctatgttgctttcctatacatatcgatatgtgtttcctatatacgtatcgatatagttaccaagaacatcttttatggccttgtctttgttttctaacttgatggattatgtttggaactctcttagtgtattcaggatgctataacaaaataccgtaaactgggtggcttataaacagcagaaatatttctcacagttttggaggctgggaagtcaagatcagggtgccagctgcttcagtgtctggtgaaggcctgcttcctagacggccatctttttgtttataacttcacgtggtggaaggggcaaggagtctctctaggacctcttttatgagggcactaactccattcataagggcttcatccttatgacctaatcaccctccaaaggccccaccttctaatattgtcgtattgggggttaggatttcaacatatgaattttgggagagtggatacaaacattcagcccatgacactgttcatttatttaataaatagttttttacgcctactgtgtactcagagctgtgctagatgctgggggtgcagtggtgataagaggagacatctactatgtacaaagtagagtggttgctgctgttgtctgcttggctactagaggcacgtggagcttcacaataatatctgcatggcacttcggagttttcaaggaacttgcacaacaaacccatgaagagttattatcacccacattacacagatcaggaaactgaggctccagaggtttatgtgtagtccaaggttgactgtctaacttgcaaggggcagagcagaaatgtacacccaggccagtctcgcgcagttcctactgtgccacactgcctcccgcactgcccaggggtggtatgggtggaacttttttttgttttgttttgttttgagacagagtctcgctctgtcgcccaggctggagtgctgtggcataatcttggctcactgcagtgtccgccttctgggtccaagcgattctcatgcctcagcctcccgagtagctgggattacaggtgcacaccaccatgcctggctaatttttgtatttttagtagagacagggtttcaccatgttgcccaggctggtctcgaattcctgacctcaagcgatccgcccacctcggcctcccaaggtgctgggattacaggtgtgagctactgcacccggcctggatggaacttaatctccatgctgatgccaatcaaaactcagtggccaggtgtgttggctcacttctgtaatctcaccgctttgggaggctgaggtgggaggattgcttgaggccaagagtttgagaccagctgggcaacaaaacaagatcctgtctctacaaaaaataaaaaaatttgcaaggcatagtagggcatgcctgtagtcctagcttcccaggaggctgaggcagaggatcacttaagcctgggagtttgaggctatagtgagctatgattatgccgttccagcctggccaacagagtgagaccctgtctttaaaaaacaaaacaaaagaaaaccacacacacatgctattcctgaatcaaatggagagcggcttcccctggggtgcctaaccaagctaaatgctcttgggatggtgggatggtcgggatcctgtgccttcattcccctgccttaccaggtgggttcagagggtatcaggagttgaagggccaggacaactccaaagctgtgacaccctcaggacgtagctggacccagcagatgtgcagaccagcttagctttgctctagttttacttgaatgaattgtggagaacacaattctagttgtggagaacacaaacatttcgaccatagcaggagccccacccagagaccatattccaggaacccagcagttactggcaacttttctggttccaagtgtccttgttcttgcctccttatgttggacctggtattgatttatgagaaagtgttgtaggtttctttgtgaagtatgtttatgatgttcagactgtttccagtaaagtttgttatcagtaccagaaaggcttattgcatttgcaggatataaattctagatttgagcatggttcctggattaatggaccatactagtaccttgaaaagcttattgaattataactcttggactcctccccagacctaataatcaaatggatcaggcctggcgacctctgtttttgaaagctccccaagccattttaatgtacactaatatttaaaaaccatggttgttggctgagcacggtggctcacgcctgtaatcccagcactctgggaggctgaggtgggcagatcatgaggtcaggagatcgagaccatcctggccaacatggtgaaaccctgtctctactaaaaatacaaaaattagctgggcatggtggcaggcgcctgtaatcccagctactcgggaggctgaggcaggagaatcgcttgaacccaggagtcggaggttgcaatgagccaagatcgccactgcactccagcctggcaacagagtgagactccatcttaaaaaaaaaaaaaaaaaaaaaaaaaaaaaaaaaaggttgttatgaactgaatgtttgtgttgcaaaaaacatataactgaatgttatgaactgcaaaatttctatgttgaaaccctacccatgtgatggtattaggaggtgggcctttgggagataattcacgttaggtgaggtactgcaggtggagccctcatgactgaaattgatggagagtcatacaagagcttgcctccccactctgttctctcccatgtgaggatacaaagtgatgttagcagtttgcaacccagaagggatccctcaccagaacctgactatgctggcaccctgccctcacatccacagtctccagatctgtaagcagtaaatttctgttattagccactcagttcctggtattttgttatagcagcctgggctaagaacatggtctggaccagtggttctaaaaggtagttcctggaccatcagcatcacctgagaacttgttagaaatacaccttatgaggccccacccagacttactagaaacttagggatgggtcctgcaaagttttaacaagcctccctgtgattctgttgcttcctaaagtttgagaaccactagatccttgtgattcaaaatgtgagctgtggaccagcatcatcagcagcatctgggggcttgttagaagtgcagggtttccggccccacctttaccaactgaatcagtatctgcattttagtgagatctgtgcatattcacatttgagaagctgcactctagatagtcgttttctttccgggatgtgcattttaacccgagatgccttaaaaagataccaaggccttgcctccatccaaggtgattaagacagaatctgtgaggttgggcgaggcctagacatggtgtgtggagaccccggtctaagagttggtgcctagattggagcccaattttcacacctaaaggataagactgtgaaaaggggtcaggactcccaacactgctttctccttcctcctctctgctcttccaccatcccagaatgtgaccccacacccaggctccaggagggaaggctcaagtctccctgcctcaaaaagatccagaggcggctgggcgcggtggctcacgcctgtaatcccagcactttgggaggccgaggtgggcggatcatgaggtcaggagttcaagaccagcctggccaatgtggtgaaacctggtctctactaaaaatacacaaattagctgggcatggtggcgccaagatcacaccactgcactctagcctgggcgacagagtgagactctgtctaaaaaaaaaagatccagagggaaaagttctctttatattttcagggttgtgtgtgtgtgagagatcgagggaggcacagacaacagcgttgtgtgtgttggagggatggaatgtggtatctggcaccaggccacagtgcttctcacacctgatgtatgtaagagtcagtcaccttcacaatgcagattcctgggctctactccagagagccagtatcagtagggcttgggaaggacccaggaatttgcattgttaacaagttctcccaaattcttcttatgtgaaagtctagggtcctgctctgagacaaacactactcaaaggctgtgatctggctgattctcagaattacttggagaaactaaaaagtacagggctccaggccttgccccagctcctctaattcagtaggactggcgaggcccaggaatcagaatgttgtagtgtaaacatatctgaaagcaataacttaagcctacccttagaatgaccctatatggcagatgcacctgaatgtgtataccgagctacggaatccaggattcattccttgtctgtgagggacatctgagccccacgctcatcctgtggagcatgagccgtgcatgggattgagacctttggttttgggttaaatggaggttgccaggtggaggtggaagttgttgggggaagggtgctaagtgaaaatgctatgtaaactgcatgctgtttgcaagtggtcgcaggtttcctgcccagcacactgccactgggcctccagcctctcccactggactgtgtgtaaggcggtctcctgtgcagcccgccgccactggactgtctcctgtctgtaagcgcccaataaaacctcatgcctcatttgctgcctccagatctcttcttgccatttctgttgaggttaataggggttcagtataatgcatgtttaataagtactctgggtttttcaaactgtgttctcagaaacccttaggattcccccaaagtatattggaggctaccaagggggagaggtaagaggagaaccaaggttgttgacaggagggggggttcaaacactcaacccgcttcatctgcttcatgtattaagcttcagtgtacaattgcatttgaaaagaggattttttttccaaattttgaaaacaagtcatagctgttcattgataagggcctctttaaagttggcagtgttctccttttgagccacagttcaggacagcctctcgcccttgtgaccacctgtccttcctgacacgctgacctttagtccctgagctgcctcatacctggcccatgatgctaactatccacaatgaccctgactccattcacattgtgggattgcctggctctgccatttgccccaattaccaaattcctttactactgaaagaatgctggtcacaccagaaatatgctttgtacaaatcatagtacctcaagacagtgagtctcaaatatggctgtggctttcaaatatttttctgcacgagaatcatctggagagcttgttaaagcacagattgctcagccccaaacccagagtttctgattccatgggtctgaggtgggacgtgagaacttgcatttctcgaaagattccaggtgggactgatgctgctggtctggtgaccacacctagaacaactgccttaagattaaataatgttggatacagcttgggtccaattctcctgttaggtgttttctcactgagtagttcctcctttggtgttaaaatatatgaggagaagaagtgctggaatgaagaaatcagtgtcagttgggattatggctcagtcctgctctgcactaattaggttttgctggactctcctgcccagctaacagccatttatgatattgtttctgcaggacagtgcattgcatagtatggtccccgtgctgctcatcgtataggccctgccagaatggttggcaatgacaaggatctgacagtagcttcttattgccagggcttgattagaatgtgacaagtcattgctgaacattggttaccataaaggcaaatattttgtcttccctgaaacaaatagtaagaggagaaagtgtcctgttgtagaaactcccatctttgtagagatttccatcctttcagtcttagacgcttgcagaaagctggcatggtggcaaggcagaggtgtcctgtcagtggccaagcaaacagcaaacacatgctcatggtcactgctgtctaggtcagaggccttcaaagctttgatcaaatacaacaccagtcactgttgggaaatcctcctggacatgtcccctcatttgttgaaatgttttgaccaggcaaatgactataattattgttatattaaaaaaatagcctttgagttttttaacctctgtaatggttcagctctgtggtggaaaatatttaacttcaattttcagaagtacacctgagtgactttattaactacccttgaacaaatgcaaggggtgagttaataaggtggttacatttgtgcaggtggtggagtgagcatctgtgagacggtggaaagaaaatgtttgtgttatgttgggtgggtaaggacaggtaaaaccaccttctccttttctgtgtgtgaggctggctggctgctttaggataaatacttccaggtgagtgtgagcacagatgctgctaggcattgtctgggagtaccctggaaggtcaggcccagcgtctcttctccacagtgctcttgtgggtggattttccagctctctttatcctgctgctgaaggaagtagcagacaatcaaaaacataaaaagaggtcctgggcatgatgccctgaaaaaacatttctagcactgggctgagcactttggtttttttgttttgttttgttttcttttttttttaaaaaaaggggtctcaccctgtcgcccaggctggagtgcagtggtgtgatcttggctcactgcaacctctggctccctggttcaaacgattctcatgcctcagtctcccaagtagctgggactacaggttcatgccactatgcctggctaatttttgtatttttagtacatgtggggtttcactgtgttggccaggctgatcttgaactcctgacctcaggtgatctgcctgcctcagcctcccaaaatgctgggattacaggcgtaagcgaccgtgcctggcctaggctgaccactttggaaacatcgcattcgatttggtccttcccttacaatacgtagaataataaaagctagcaatgttggcaggcttcctgagttccagactttgtactggttgcctgacgttgaggtgggttctgttaaaatggggtcgtatcatagaaacatcgaatgtgcttgaatgacgacatgtgcttggcagaggcaaagagattgtgtttaaacaaaacgacctgctcaaatgtagaaagacattttgagagccagtatgttggtcctactgagtagatttgcaagagtaattttgactgtaagtgattttcatcttaggaactaacttcactccctgctttgctccccctccaaatgaggcttctttcaaccatccccaatttatagatgttgcagttgaggcttaagagggttaaataacttgctaaaggtcatgcagccagttagtgatggaagtcagatttaaacctgtaaacctatgcattccaactctgaaggttacgcttgtcaccagtgctggggcatgctgtggtgtatgcagagctgtgcaaccaggtgacggcagaacttgaagcgctgtccacatgaggagtaactgcaggaatgggtatattgagtcagaagaaaagaagtcacaggcagggtggtagagcttccttccaaccttgtggaaaggggaggcaatgagtgtagctctgggcatccattttaacttggtaagaggcatgaaagttgtaagaatcagaatgtcacttgtgtcaaaaccctgacaaatagagctgggagaggccacgaaaagaaggttctcacacatatatgcctgataacaagaactgtcacaaaaacctctgcaaaaaccacaaccttgcacaaagcctgtggcagtcttacacacaaaaacatatttctgcaaggacatctgcccagcaactgcctgtccaacgttgggttgatgccaccattgttactgatacctgtacccaaggataattgtctcaaaacaacttatatagccatccttatttttccttgaaaagcccttgttttcctttatctccctgaatacactcacatggattcccattgcaatgcccattccttaataaatatcatttttttttttttaaagagagtctgcctcgctgattgttacttaggtttgataaggtaaagtcttttaaagatggagctgttccaacttcactgggctgtttgcaggtagagatccttgttggagctacttaacttgtgcagagagattgtagatgagttttaatcctagggtaaggtcctgcccatcctgacagtcagtgacttaagctttggccacactttggccagtttgtatttgtcctcacagagttctgtgggctttatgataagctgtttgatggaatccccttatatgggcatggcgatttttttttaaacagctttattgagatataatccacataccatacaattcccttaacgtatataagtcaatttttttgtatattattttaaaaattatggtaaaattggtcgggtgcggtggctcacacctataatctcagcactttgggaggctcaggtgggcagatctcttgaggtcaggagatggtgaaatcctgtctctactaaaaatacaaaaaattagccaggcttgttggtgcgtgactgtaatcccagctactcaggaggctgaggcaggagaatcacttgaatctgggaggtggaggttgcagtgagccaagattgtgccactgcacttcagcctgggtgacagagtgagcctcagtctcaaaaaaaaaggaatatatatatatatatatatatatatataaacataaaatttgtaaaatagtatttattgtggctagtattatcaaagatgagtatttttctgcacctggtaacttggccaggaaatcattggaaagctggctttgcatttgtatttgatagtatttagtgcttgaaaatgcatggatatggaggcctatgctgggtcttctccctgcatcacaggattcatgaagttattaatcatatctgtgctgatttttattttgacgacttgttcatacagccacagctgtgagagttaatgcagcaggctcagcatggtggaattagcagaagccctggaatgaagtgaagtgactctttgggaagattcagttattcctgcaagatgacaaaatacctaaaaccaacacaaccatttatttgcttatggttttgcaatttaaattggacagggctcagtagggacaacttgtctctgctccatgtatcagcgtggacggcttgactgagagcagaggatttacctccaaggtggcacactcatatcactggcaaggtggcactggctgctagttgggagcttagctggggttgttggctggggacctcagttttcttccaggtgcacctttccacatggttgcttgggcttctccattacatgatggctaggtcccaagaaggaagaagtgttgctgcctgaccttcctgatgcctgggctctcaggtcttagtatggcacttctgcatgtcactttcagaacagtgacaagtccagctcagattcaagagagagggaacataagctctaccttttttttttttttttttttgagacagtgtgtttctggctggagtgctgtggcacaatcttggctcactgcaacctccgcttcccaggctcaagcaattctcgtccctcagcctcccaggtagctgggcttacaggcgcccgccaacatgcctggctaatttttgtatttttagtagagatggagtttcaccatgttgggtaggctgctctcgaactcccgacctcaggtgatctgcctgccttgacctcccagactgttaggattacaggcgtgagccactgtgcccggccggctctgccttttgatgggagtagcagcataaagtggtagggaggggtagaatcatttgaggtcatctttagagactagctaccacgaagaaccacaatggtcttttttctctttcttcctcattctcactccacagaagcctgtccctaatcattgtgtgagccagtgatgacaaatactggcaagaaatctaagaaaaaatttaaaaatcagtactaggaatacatagtatttaagagatcgtggcttggtctcaaactccctacctcaagtgacctgctcatcttagcctcccagagtgctgagattacaggcgtgagccactgcacctggcctgctcttaatgattatttaaatttatatttgtttagtgattacacattatttgcttacttctgacatactctgagtctcactcagatcagagattataggagggggaatatatttactagaataatttctccattcagaatgtcagaaataagaaagccttttttttttttttttttttgagacagagtcttgctctatcacccaggctggagtgcagtggcgcaatcttggctcactgcaccctccgcctcccggttcaagtgattctcctgcttcagcctcccaagtagctgggagtacaggcacctagccaccacacccggctaatttttgtattttattagagacgggatttcaccatgttggccaggctggtctcaaactcctgacttcaagtgatctgcccatcttgatctcccaaagtgctgggattacaggtgtgaaccaccatgcctgacccgagaaaacctactgaacatttttaaattttatatgttactgcttggaaaacagagctttgcttgttcctttcagctattccctgatgagcccttaaagtccacaattctgtttcagcttaatttctgaaaatagttataccacattttcacagtaagagagctagtagccagatgcatcgtgtgttttgtttgcaaatgcatcatctgctgtctagcttccttccatggagaggaatggccttatatttcacagtgaggcttcaactgctgctcccttttggcatgtcaaagtctaattactgtggtctctgtagcaggggctgtatccacagcctgcgaatgtttgtgttctacgatgatacttgggcatcagtgacatttgaaaggggtggttttttgagacggagtctcactctgtcgcccaggctggagggcagtggcacgatcttggcttactgcaacctctgccttctgggttcaagtgattctcttgcctcagcctcccaagtaggtctcgaactcgtgacctcaagtgatccgcccgcctcggcttctcaaagtgctgggattacaggcgtgagccatcatgcccggccttgaaagggtttttattttagcatcaaaaatctatggcatggcttggattgcatttcttctaggctgttccatccttagtcacataatgctactaattcacctgaaggaatgctgtcaaaataaatcaaatggtaattttaaaagactctgtctcattcattgtagcttttactcagttaagaacagtttggaaatatgagccttgagcatgagaacactcacgtagcattttattttagcttaatgctgctggctgtcattttgccgctatcactgttttacgctgaatggttaaatgtgagaaagaaagaacaaaatggtagcatattgtgcttgactcattgagaaaggctgttttaggttaatgtagaattccaatagtagaaagaaaattctatcccatatacaaatgtgacttgcctctcaagagcttctttgaaggttattttggagcgtgtgggggatgaatttggtgcataggataataataattgacatctgtctggtgctactctgaaccaggaactgtccctaagtgctttgcatgtattaattaatctacatataagcgctctttgtattatttccatttacagatagaaaaattgagatgtaaaaagataatagaaacaaggccacacagctagtcagtgttgagctggggcttggttttgactgtctggcttcagtggactctggctttagccactatatgacactcgctaatcaaagtaagttatgttttcttagtcttttttttccctttatttgaaaccaagtttcagatgttgatttgcaagttggcagtcatttctgttttataaagcttattttttattgccccagttttcaaaaaagcttttcttgtttaacatttttgcctgatgaaaataaaagtcaacttttcaaacagattatacatgttgataatagtgctagtcatatgaaccactaatagtatgttaagaataagtttcaaagtaaaaataatgtaagttccaacatagtacatttatcatatagtcgagtgaatagtactctgtctcacatattgtttagattgtagaaattacagcccttaaaaatttaagtatgtttaaagtagcccttaagtgaattaacatttcttttttaaaaaaatattattgatttttgccaaacaataaaagtaataacagacttttagaaaatctggaaagtataatatggtataaacaaaaaattaacactgtgtgtaatttcaccacttataggtagatgattcattcatgttagcatttaagtctatttgccttccagccctcattcatgcatttactccttccacgattactaactgattatcttctaggcgcagggcaaaagcagcaactaaaatagtctttctccctgtggagcttatactttactggaagaagtggacaatgaccagataaatatgcaatatgatgtcaggtagggaaaagtgctttaaagaaaaacaaggcagggtaggaggatagaggcacaagggctgctgttttgggaagggcagccccagagaaggctgagtggttttaggaagggagcctgtgactgtctggtgaaggacatgacaggtggggacacagccagtgcaaggccctgtgatggaagcaggcttggtgtgtctggggaccagcaagcaagccagggtgaccggagtgtggcactcaagggagtgcaaggaaatgacatgggagagatggcagaggtttgcaggctgtaaaaataagggctttgcatttcactgagtgaggtggaagcctttggagggtttgaggcagaggagtaatgtcatctgggtttggttctaacagattccttctggttgctctggtgagaatagactgcaggggataaggtggctgggagaagggtttgcggggaggtggtgagaaaaatggtcagattcaggatgtctttaaagtagagctaacaggatttggagctggattggatgtgtgttatgatgaaaacagaagagtcacatatagtgataacttggtgttgtggtctgaaatattgcccttccctgattcacgtgaagtcctaacccccagtacctcagaatgtgagcttctttggacatagggtccttgcagatgtaattatttaagatgaggccattccagagagtgtgtatgtgtgacgtaatccagtggactgatgtctttatgaaaaggggatatttcagcataagcatataataagagggaagatgtgaagatatagcaataaggacatctgttaagccaaagaacgcttgaggctaccagaatctaggagagaaggatgaatagattatctttcagtcctcaggaggaaccagtcttactgacatcttgatttcagatttccagcctccagaactgagtggtagtaaatttctcattttgtgatacttcgttatggcagtcctagtaaactaatacacttggtgagcaaccttgtgaatggccgtcccttttaaggcagtgaatgccaggaaggagcaggtcttagagtttggggtggatggaggggacagaagacatgctaagtttgagaagcctgttagatacccacatggaggcatcgatgagaccgttggatgtggaaatctggagttccaataagaggacaaggccagacatctaagttcgggcactgaattagatcttcaggagaagggtccaaggatcaaggaggccctgggaaattttgacatttggagggtggggagagaaggaggagacaggagacagagcagaggatggcagtgaagtgggagaaggctggcagggcgtggtggctcagcagccatggggggacatggggaggaggagggaccaggcctctgtggccagcatggctgatggtcaggaatggagaggaccaagaactcccactggatttagcagcctggaggccactgatgacttggacaagaacagattccgtggaaaagcggaaaagtggatgcacaaggctgattgaagggagttcaagaggaagtggcattacatcataagcattatccagtgtcattaaaaatctttttcaatcagaggctggctaggaagagtgcatgggtgtgtgggggggatgaagagaaattggttaatgagcacaaacatacagttagatagaagaaagaaattctgagtttgatagcagagtaggtggctaaagttaacaacaatgtgttgtatatttcaaaatagctaggagagaggacttgaaatgttcccaacacatagaaatgataaatattcggggtgatggatgccctaaatatgctgacttgatcatcacacattctctgcaggtaacaagatatcacatggaccccataaacatgtacaaatattatgtatcaattaaaaaaagtttttgaacattgtttttgatgactgtatcacattctaggattttaatcctttttttttttttttttgagatggagtcttgctctgtcaccaagctggagtgcagtggcttgatcttgtctcactgcaacctctgcctcctgggttcaagtgattcttctgcctcagcctcccgagtagctgggactacaagtgcgtgccaccacacccagctaatttttgtatttttagtagagacggggtttcaccatgttggccaggatggtctcgatctcttgaccccgtgatctgcctgcctcgacctcccaaggtgctggaattacaggggtgagccaccaggcccggcctaatccattctttacttgttttatgggtaggatggttctaacttttaccactatattggttgtgatactgcagtggacatatttgcatacaaaattccctagattaggaatgacaagacacaacaggatgattatttttagggcttaatcctaaaatatggccagtcatttacagaaagtctgtaccagtgtacactcctcttggcatgtaggagtgggcttgtctcactgcacagctcccctccatgtatttttgaattgactagaacatccagaaaagcattgttacagaggtgatggtagggcttatgggctgaattttgtttccccaaaattcttctatagaagtcctaatccccagtatctcagaatgtgagtgtatttggaattagaatctttaaagaggtaattaagttaaagtgaggtcattagtgtgggccttaatccagtgtgactgatgttcttataagaagaggcaatttggacacagagacagacacagagggaagaccgagtgaagtcacagggagaagacggccatctacaagccagaatgaggccaactctgctgatgcattgaccttggacttttagctcccagaattgtgaaagaataaatctctgttatttaagcccctgactctgtggtactttgttatggcagcctggcaagctagtacagtgggcattagtgttttgttcctgatttacaggatgatgtctctggtgattatactaaatcatactggacctgcatactagacacatatatttaagaatatattataatttatcctcccaaacctgatcgcttatgaaacataaatcctgaatcagtggggtctattcccattttgctgctctgtggcagattttaacactgacatttggcctggtccgtgtgttatttatttctctccgatttcaggtctcctggttaaattcatggtctcagggaggtctttcctaactccctgacccccactgtgatcaccccccatcagacactcctcttctctttccgaaagactggtaatagttataattactttccctgtggggtctccctggctgggttgtgaatgccaaggggcagagatgatgtaaaaacatcatctctgtttccagttctagccacagggcgtatgacagtgcctggtgcaaaattgagcatagaattgtcactcagtattttgttgaatgaataaggcatgagtcaaacttggccacttgcccaagggcacagagctgggatggggtggggggggcttcacactcaaatctctgtgaccccagagcatagctccctcttgtacgtgtctgctcatcagtagatgagcttgggcaaggaggtgtgtagtcacattttttgattttctctcaggctcggtagtagctcctcaaggaaacaaaccatttctaagaattctttgtatcctttatggtcccttgaatataataactcacaaatatttgccaattgtccaattaaggccgccatgttcctctttctacacctttgttattatgacacgtagctgtatggtgattctttttctgtacttgtgtctttcctattggactctgatctacttgagagcaagaaatttgtctccatcttttgtctgcagttcttggcacaatgcaggcatttaagagggggctcaattggatgaataaagataacatggatgggattaaaacaaatttaaagattatttagaaaggtattgtcttcctttgaatgaactctaaagataacagttataacaatatatgtgcataatagtttacagtctgtaaaacccaagatttttcaaaatatgtactcatcatacatatatactagcatgaatgcacaaagtaaaattatactattagagaaggtgcttaaggagtgaatggcagtgaataatgaaataacgtgttttaattcactttatcaatgctttaaaagctggtagtatcactttatagttctaattttgaatggctgttaataccatattctactcaacctttatggttcttttaaattttttcttggcacaaatagcgctgctgtggacacctacatatatgtatgcccagttatttcctttttttgattattagaataaatttctaaaaatgaggctactgaaatatttgaaacatattgttaaactgctttctaaaaaggcttgtaccatattccttacctcctttgcagcacttagtactaatatttatattttctaaaaaattagccgtgatgtatctccttgttttagtgttcatctcttttgatgactttgttaatttggacattaccctataagtttctttactaatttcatttccctctgtctaaattatctatttctgttctttttttcattttttgattttggtcttcctttgttaaaggcaacttttattaattttttttatataatagcattttcagaaaaattttttttctgggttatttttttcccttttgctattttaattaatgttaaatgcttatatacactaaactgtagatagatattttaactttttcttttttttcattgaatgcctgtgattaaaaaaagttatacatggcagtgataagatcagaaacaatccaggaaaactgctggttgttttgtattacaggacttgtgatttaattacgttatattctgtgagtgcttttacaactattgacggtattgggaagagtgtgtttgggcccagctgaccacctattttaaattacatcacatggttaacaaccactcctgctgagcttaggtttagaaaacttcaagcttccagaacacagctcttggggagctgggaattctggggctgtgtacttgacataaaggcattaaactcctgaatgaaacatgagattctgtacccagcctttgtgacttgtagtccctttaatttttgctatgctcaactatctggttggtgaagttgttactcgtaagattagaaaggcaaatagggtaggaaaatagggtggaaagaatgcttgtgtgacttgacgatctgactcagagggaagagagagaacaatgaaagcaaacacccatccctcacaggtttcaaatagattttcataaggatgaaagacctgtaaagatttattaaatatattggtgattgatgggcatggtccacgtatttagaaaatttcattatgtggaattcttcattattccaggagactggatagaaaaggcattgggatgttatgctaatttttttttctctttagggattttggaggaggctaacccagagacatttacaacgaaacaacagcatttatttggatttggtacaaggagcaagcagacagagtagactaaaatgtgtgacctcatgctatatttcttgtgatctgatatcacttagtgttattgaatgacttcaaagggcagctgggaattactgtgaagacacacacagcaaagcaatttctcacctgctgtctctgatcacagaagacacagttagactcacatttctccccaggacacatgcggtagacatgctgcaacttgtttggagagaaaggcaaggggcagagagtcacactgtttgcactgtgtggactgagacaagttttaaatataactaagggttacttttttagaattaaaaacagtagaagctgagcttcagggcatgggttacttcctaaaaatacaatcactgaacttttaaagaactctaggatcagcttgtcaaactggagtagatacgaatgtgaaagacatctgagactctttagtacttggcgcacagattgagaattaactcaattttgactgtttcaaatgatgaaagtattttcagaagaccaacctggtagccaggatggtgtagggttttgttgcttaacctgctcacctagatcttgatgtcagtgggctttctgcaagcccactatctgagtttatcgctgtcttggtggcagttttggccacttttttttttttttaagagatggggtcttgctatgttgcacaggctggactcaatctcctaagtgcctacaataacctcctaaatgttatgccccttgtgatgttctcttctctttgaccttgaccagtttgcttcactgtcgctactcttcagagttcctctacaacacattggatctggtttctgaacctgtttctatctgtaactataacataaggttaaatgtcactgcagactttgtgtctttgcagagtttacttgaatttaattttgatggaaaaacatctgctttgaaggattggagactgcttgattgaataaatcgcaaatcaagtctgcaagtgtagatgttaccatgtaatgaattaagagaccattggccatctttcctttatagacgtccttaaatcccccagcatcatttggaaagtagtggctctatgtttatatcagtcagtcaaccaagtttaggctcctatcccaggctacagaaagttctgcataagtcacttaactgacctcacagcttataacctagttggcaaataggagagaactgtaagaagttgactagcatgtggaatgtgaatgatgacagtggacaagagccagatggtacaaaggtcgtgatagggctgggtgggtgggtctgttagtcacttctcacactgctataaagaaatgcctgagactgggcgatttataaagaaaagaggtttaactggctcatggttctgcaggctgtacaggaagcatagcagcttgtgcttctggggaggcctcgggaaacttccaatcatggcatgaggcaaatggggagcaaggcacaaaacatgaccagaggaggaggaagagagagagtggggaggtgccacacacttttgaacaaccagatctcagaatcacccactcactcactattgcaagaacggcatggatgggatggtgctaacccattaatgagaactctgccccatagtccagtcacctcccaccaggccccacctccaactctggggattataattcaacaggagatttggtaggactcataccaaaccctgtcagtggacatttgggagagacttcatacagaagggtgggagaagggtgggcttgaaggcattggaggttttaattgttctcattggattgaggggcctgtgctcctgcatagggctccctctgtgcagagacaaggaggtgggaatcccagaggttgggtgagcttctgcaggggtagaccagtgagaagtgagggtggaaaagggggtttgggttagatgtagatggccttaacatttacccttggtcagctaaaatgtgtggaaagtttttgaatgaaagggaaaaaaatgattcaaagagtagcgttttagaagactagtctgtccgcaagcctggattaggtttttgttcctaacccactacttttcagacttggctgtatatttcagtcacctggggagttaaaaaagtactgaagcctggagccctcccccgctagagattctgatttaatctgtttggagttaggcctgggtttggggagttttaaaagttccccaggtgattctaatgtacagccaagcctgagaaccaccgcccaatccactgataagatcttgatatagcctccactcagcctccactcatcgagctgaaccacagcacagtgctggccaggaaaaagcaatcaactgatgggaaaaaaaataaaattaaattaaaaagtacttctggctggctgggggcagtggctcatgcctgcaatcctagcactttgggaggctgaagtgggtggatcacctgaggtcaggagttcaaggccagcctggccaacatggcgaaaccctatctctactaaaaatacaaaaattagctgggcatgcatgcctgtaatcccagctacttgggaggctgaggcaggagaattgcttgaatctgagggacagaagttgcagtgagtcaagatcgtgccactgcactccagcctgggtgacagagtaagactatgtctcaaaaaataaataaataaaaataaaaggtacttctgtgacaatatttataatattccacatagtccaacaccttagttataataagttttcacgtaaatgctatgaatttttgcattggccatgaagtagatggggacaaatgtgtagacttttggcaatgtatagatatggaaaatgacatctaaaattgcaataaaaatggcaagataaaacacttttatcatagccaagaattcagtagcctaaaagcaattacagcatgaaagcttgcaagtataaaaatataagtcctcagaaacttgctgctggaagacctgtttccagatgttgtgtgtcagtgattctcaaacctgagtgtgcatcgacgtcgcttggagggcagtcactgattgctgggctccagtttcagatttagcaggcttggggtagcccaaggatatgtagtttcaaagttttcccggatgatactgccggcctgggcaccatactgtgagaaccactgatgcttgctgccatgtaagaactgctactgcatgggcccaaatattgtaggaaaaggggcttgataaatgtgatagaaggacatgagttgttttgttttgttttgttttgttttttgagatggagtcttgctctgtcgcccaggctggagtgcagtggcgctatctcggctcactgcaagctccgcctcctgggttcacgccattcttctgcctcagcctcccgagtagctgggactaaaggcacccaccagtacgcctggctaattttttgtatttttagtagagacggggtttcaccgtgttaaccaggatggtctcaatctcctgaccttgtgatccgcccacctcggcctcccaaagtacaagttttgctttttatgtcagatgacgggcttctcttgggagttagggaatctgtcctcctccagttcaatccagcccctcctcatctccgtgctctagggggcacctgtctgagtctaggtagggtaggtagaagagaaaattgtcttttcattctcctaattgtccttttaaaatgtactacaaagggaggtattatatacatagctgtaatattatataacacgttctttacttttcttccagtagaaaatatttgtaagttcaaagttttttttttttaacttttatgactgtctccccaccccccttaccctaccacatgaaaaatttgaagagttaaaaaaaaatgctaaccatccatgtcttccttaaaacaggttcttgcggctcattcttggtggtacattggaggatgtcagtccttggcctccccctaggtgccagcttttgcaccaaacagccttcctggtagaaaacacatttgcagtgtaccttgggcgggaggagaagcggaaatcattctcagatgttaaaaagaaacatgtttctaattgaaagcatgatgagaaggcacacatgaaagggcctgggtggtgagctcaggccaaggcacagctttgaaagcccagctcagtccttgctgtggccacttctgttctcttgggtggatcccattcccattcctgtgacattccagaaataaccatggctgagcagggacccaggacagcatctcagatatagcaacaaagtttgctcagttggtcaggaaactctgatagttagaattctgaattctagaaacacagagcttttgaactagaattctagaagcagagtgtgggaacagcctttattctcatattgtggagaccattttagaacaaatcgctgctgccctcctcataacccccaaacacacacaagtgcagaggccagggttaagtggcttactccaaggtcacctagggagctggctccatttttttttttcttttagagaatccttcccaactttctgaaaatttgtcagcttggtattctgacacccaagggccattttagaaaaatcattacttgctgtaacgaataggcatcatattgtaggaagatgggaaaattattttgtctcttttatagaaaatcaataggttttgaggcttttaggtcttggtcttttggatcttcataactgagtctcctgttgttcgttttgcttgtctattttgtaattgctttgtggactgaagcttgttttgaactttatgggagacttgatagtgtgatctgcctcaggaccaacagtttatgtaaaaggtgagctgacagcaacagggcagcatagtaaatgtatttgaacaaataaagaagggactgaaggaatcatggccataagcttatgacattacataataaaacttaagtcagtagcatgtacacttcttttttttttttttttttttttttttgagaccaagtttccctctgtcatccaggctgcaatgtgtggcaccatctcggctcactgtaacctctgtcctctgggttcaagtgattctcctacctcagccttccgagaactgggattacaggcccctgccaccacactcggctagtttttgtatttttagtagagatgaggtttcactattttgaccaggctggtctcgaactcctgacctcaagtgatccaccgggctccgtctcccaaagtgctaggattacaggcgtgagccactgtgcccagccagtagcatctaaacttctaagggaccttgcctatcataaaacctacttactctaccaatgacccacagccctgataacttctctttttaaatttttaattttgagattgggttacattctgttgcttaggctggagtgtagtgctgtgatcacggtcactgcagcctcgacctcctgagctcaagagcctcctgagtagctgggactacaggtgcgtgccaccatgcccagctaattaaatttttttttttttttttttggtagagacagggtcttactacgttgctgaggctaatctcaaactcctgggctcaagcgatcctcccaccatgacctcctaaagtgatgggcttacaggcgtgagccactgtgcctggactgataactttaaaactctgtttggtcaggagtgtggtgattcagagtacatacatccttgcaaataggagatgaagaagttgtttctttttggttgcctttcattattaaattcggaatggtgcctagcacactggatttttatacaaactagcaggtgtgttttgggcgactctcaacctttctgcccttggttttctcgttttctcgtatgtcaaagagtagattggactaaatttctgacacagtctctcgaagatctgatagcctatacaacatgaggtctataggagagcactttttggggttggggattggactgaacttttgttttttgccaagtcttggcaaaaaatttaggcttaaaaaattttaaattaaattttaagttaagcgtatatttaaatttaagccacagaacataactttaaaataatggcagagcattttcttacgatttttcctggattttctgatgcatttctgggaggcagatgcagtaaaatggttaagaatgatagctttggagctggctcacttggtttcaaatccgagctcttctactgagtaataattatataatgtttaacaaatcacttaatctctgtttctgttttttcatctgtaaagtgggcacaataaaatatctacaaaacacgttgctgggggattacatttgtttatatattttagaacagtgcctgtcacataggaagccattaatattagctctcttccccctcctccgcccaactgccccaccttcctccttatgagtatttgtgtggttttttattggagaacaaacaacctgatgctactgttaaccctttggaaaaattaggaagtctacaatgttgttcttcaaagctgtgccttctgttttctttctgcagctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcagtgagtgtttcgaactttcatttagctaaggatcatcttaattactctcttggatgccttgctttaaatcactgtccctttcctgcacaatttgcagaaatcacttggataataatgtttttctttcctttcttaaggctttacacgttaggctttacacatggaatctcttaaaaatatttggtgtgtgtatttagcctctgcaggaaattttaccataagtacaacccatggcaaccatgaggattatagggatcaagactggaagggaatgataaaaatagttatttttgataaagttgttagtttaaaaattctgtttttgaggggggagctgctttatagagttttgaaataataatttaaaaaaagaaacagtgttatttttaaagttatctggaaaaggtaagaactcagcttgcacagagaaactactcaaatgaaagggagtccttgcaaagagagaatttctcaacctcagtagcaggttaagtgtaccttctgttaacaccatgtttatctcccagttgccgtgtgggtccatttttggtgaatgagcttgttttctatttatgggaacaaggttttttttttcttagtgttaggaagtaagtgctattctgaacaaaatgagaactcagagaagaaagattaccccgttctctgagttgcattacaagcagccactcagctgcaccgggtccttaaacaaattgtctcctcttaatgagctattctgtatggataataagatgcagaatgtactgcaactatcacttgtcatttgtctaggaaggtaaaatacaggaagttcccaacttaaaaatgggcttgacgtagcagttcatttgtaagtcacttgcttggaatttagaatgcttcttccctctgcagagacagcttccatatggtgattagtatccagtcagcccacagaagttattcagtctgttgctatagatgaaattatccttatttttacttccccttcgaatagaccacctactgtttcttctgagtgtggtctttttcttttctcctattccctcctcaatcctcttttttttttttttttctgtttttcttcattattctctaatttcttcttgtctcataatacttcagttctattgtggtagctagatttagggactagtttgaaatgctactttgctgttggaaaacacattctgcagccctcaacaagaagcaaaggtaagataggtatagctaatacttagtaagggcttactatgtgccaggtactcttttaaacacttattgtgtattgttcacttacagctcacaaggatcctgtaaggaaggtaacattattaaacccattttacagatgagaagactgaggtacagagtggttaaatagtttgttcaaggtcccacagttactaagtgacagtattacaatttaaacagaggcagtcacgtttcagcatccatgccctgaaggaaggagttggcaaaaattttctgtaaagggacagatagtaaatatttttagctttgtgggacatacggtttctgttgcatctactcagttctgccatggtagcacaaaagcagccatagacagtgtatgaattaatgagtgtgactgtgttctaataaaactttatggacattgaaatttgaatttcatataaatttcacaggtcatgaagtattattcttttttaaatttttttctcaaccattaaaaaacataaaagttatccttaacttctgggccataggaaagcaggctgtgggctggatttggcccatgaactgtagtttgctaactttttctctaaaggatagtagtgctttttttgtgtgtgccagaacatgaatataactgtgtgtccttggaacggtataaagctttgattatatcatagctagacatctcccttccaacattgttttggatattaaaaacaaaaaacaattctgtgttgaactatgctttggcgatcaagagtcagattactgtgaattgcaattagttttttctagcattatgacttacataaactgtaaagtaatttacaagcaacattattcatcttcaatatcaccatccactgttagaatttgaccctctatgatgtatatatatggattgttagtaagaaccgtatgtcggatgtcagataaaggaacagtctattttttttccttccttttggtagccgcggtgtactttagacaagaatgttgtgagtcaaagaggaggctaaggtttcagctctgactcagctttggtaaaataaagtcattaggcagtttgctttggagacttcatctgctgaatgaagatgcttttttatggtagcattgttataggcatgtatatatgggtgtgcctactggtgcacttttaagtaaagagaagagatgagaagagatggccttgggtgccatcaatcctgatattaataaactatatagtttgccccattatctagtccctgcagagaagattaagatgtacaagatccagtcctgctcttaaggagattttgaaatgacaaatgagctatacaaaggaaactatacaaagctatagaattagccctttgattaatttaggttatgacataatcacagtgagtcatgtttaatcaaatggccaaggaatcacatgtgataggcccactttggctacttttgagaaatgttacaatccttaagttatctttcagattgcctattttaggatatttcaggttttgtgtttaaccagtaaaggaggagattgattaagcctccttaaagtattcaactatatacataaatatgtctaacatgccaaaatgtttagtgttacgttcattgtgtgtcacatgaagtgctatcatcttgatcacttattcaacaagtttttatggagcatattttatgtatgagggcacagttcagggagctaaggatagataacactaggcaactacataaaatgtctgctttcttggaacttacagtttagagagggagagacagttgataaatgacataattaaaatacacattagatattcataagtgctgtggagaaaataaaactgcattagcagataggacatgctgggttggtgtgtggtggggaagagtgaggggtgtggcagttttaaataggctgccagggaagaccctactgagaggcatttaagcaaaggcctgcgataagtgcatgaaccctgcagatatgtaggggtgaggcagaggctttgaggcaggagtgtgcctgagatgtttgaggaacagctagtttggtaaaattgtagtgttaaaagcacatattttaggcaggtggggattagatgaattggttttacctttggctgaattggttttaggcaacttgatttagaaccaaatacaaataaagttccttaggaaatcaaaggaaagagcagttgtttccagattttggagtgttagtgcagtggagtccagggatggctccttagagaaggtgtctgtgaaaagatggttggattcagatacatacaactggaggagaagggtgtatccaggggaggcaatgatgtgaggctaggtagcctggcatattagttttctttggctgtgtaacaaatcaccccaaaacttagcaacctaaaataacatgcatttattgactgacagtctgtgtcaggaatccaggggctgcagccaagcagtcagcaggggtggcagtcatctgaaggctcgactggggctggggaatccactgccaagatggctcactttcatggctgttggcaggaggccttagccctggcactggctgttggcagaaagcttcacttcctctctatgtggacctctctgtagagcagcctgagtgtcctcacaatgtggccataagcttctcccagagtgagtgatcctagattagggagagcgaggagaaggccacagtgcctttatggtcttggtcttaaggatgccacaccctcacgcttaccttattgtactgattagtagtgagttgctaagtctagtcctcactcagagggggtagaagtatgctgcactgcttaaatggagaaatatcaaagaattcgtggacatatttaaaaataaccatatttaggatatgatttaattagaacttgataaatatgaagattaacggtaatataaggtaatataaagctctaaaggttgcttgaaaaccaagctactgactaagatttcaacaaaacaattccaaaaagacacaaaatagagaaaaaagtaatggaaggacgcctcgtagcttaaacaaggcttaagaaacacattaaccaatcacagtattttgattatgtttctatcctgtttcaaacaaactgctaataaaagaaaaagataacaatgacgatttatagaacaatcatgaacatgctaacattggtaatttgatgatataaatgaatgattgttgattttgggagctgtgatgatggcattgtagttatgttcataaggaggagaatcatgttaaagtatttacagatgaaatgatatgatatatgagattttattcagaataatccagtgggttgaggtatagaggtaataagattggcttgaggtggtaattattgaagcttgatgatgggtacataggggtttcttacaaaattctttttatatttttgaaattttctgtaataaagagtaataaaaagatgaagtttcttatagtcctgagtgtggtcctgagtcttcaaaaacctaatgctatgatatctccaaggatggaagaacttctgggatattccttgaagtatgccacctcctaattgacaatagtaacaataaaacgtaagctcattctctttatttgtagtaaaggaaaaaaaatcccattataaagctatgccaatagttaaacactttggggaaagagttcaagcttgttgcagtactgatagttattactgggaccttgtctgaacttattaaaggatccaaggaattggtcagtagtcaaacggatgatttccttaaacgatctctcagactgtaggaggggaccttgctcaatattgaacccccacctcaaccccaccaactctctcccaggtttctcttgtgtgctttcctgtacttaacattgtcatgacacaacacagtctttgatctctttgtccacagaggtacacagaaaggctccaatcaatgtttgcttaatatatatatatttagagttttgcctagagaaaataagtgttaataatgtctaaatccttgtctatggattgtttcacgaatgcttatattgcaggacgtacccttctctcttggaataatagcatttgcctttgtaaagccctgaacattttgcagagtattttccattccttatggtatgtggtctgcccaacgagtctgtgaggtagttgaaggttttgatcctactttattatgtggaaaaaaaaggcattgaacgaaagttgaacaaaaggaactcactccaaggtgctcagtgctcaattcatgacacctggggaatgggatgagaactaaaaatttgaaccaatcactgattttatcgtgttatacatatttatttaaacttaaaaagatgttaaattgaaattacatacagaaaagtacaaaagtcaaaagtgtacagtctagtgatgatcccaaagtgacatattcatgtaagtgccatcaacattaaatagaacatttccagcaccacaaagccccttgttcttagactcagccatcttcctcctcaccggagggagctactctcttaacttccaatgccagagatcagttctgcctgtgtttgaactgtatgtaaataatacggtgtgttttttttcactcagtgttatgtctgagattcatctatgcagttgtgtgactatagcttgctcatttatattataccaccaatgcttaccacatcatgtgagtgtaccacaattcattatttattctgctcttgatggatgtttggatttttttcaatttttggctctttttatcccagattgactaaggtataattgacaaataaaaattgtatgtatttacagtatacatgatattttcaaatatgtacacattgtaaaacgattaccacaatcaagctaattaacatatctcttatcccacatagttaccatttttggtttgtggtgagaatgttgaaggtctactctcttagcaaattaccagtatacagtatacagtattatttactatagtcaccatgctctttgttagatctctgtaacttactcatcccacgtaactaacattttataccctttgaccattttttggttcttaatactgctgtataggtatgtatatgtgaaaattctagaagaaggccgggcgcagtagctcacacctgtaatcccagcacttttggaggcctaggcagctggatcatgaggtcaagagatcaagaccatctggccaagatggtgaaaccccttctctactaaaaaaaatacaaaaattagcggggcgtggtggcatgcgcctgtagtcccagctactcaggaggcagaggcaggagaatcgcttgaacccgggaggtggaggttgcagtgagctgagatcgcaccactgcactccagtctggcgacagagcaagactccatctcagaaaaaagaaaaagaaattctacaataagacctttttgaaataatcaccaagcccaactggatatagcagtatggtagtttgagaaggacttcctaatccatgaaaaccatgtaaagtttgatcatatcattagctattggtcagacctattttgttgtttgagaaaaacagacacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaatgggaggtgttgggatagagtttgcttcctaatacaattgaaataaatcaggataatgttttggtgctatgtaataataatagttaatatgaccaattattctgtgccagacacaattctgagtactttttgagtgttgtctcatttaatctcttcaaaaccatgtgagaggcctagcgtggtggctcacacctgtaatccctgcactttgggaggctgaggtgggcagatcatgaggtcaggagttgaagaccagcctggtcaacatggtgaaaccctgtctctactaaaaatacaaaaattagctgggcatagtggcgagcgcctgtaatcccagctgtatctcaggaaaccaattcaaaaagtcactgattggaattagcaaaactttacttaatcatcctggtcaccatcccaggccagtaagtagttcagctattcaagtaccataaagtcccattctttacggtacttgtagcaaatgatgggacccacttcttgtatatctctggatgtcataagggttttcattgatcagaccatatttaattttctgtgtcttatgttcttgaccttgcagtgttgaatcttcttgctccttgcacttagaatggctgtgatagacataaggcatgttaacaaggaaaaggctgacggcaaagcccaggcagccagcctcttgggaaaattactgaaactggtactataaatccagtttatgggcttgaaatttcctagtactcatgaatattcaattaaatattgatatgaaccttgacacaagtttggctcaagtgctggtagaaagcaaacagggacattcagacaaactttaattatttttcacttagagatcatacagttctagagtagtgtgagtaattggagttagctctcaccaaaacacagaagaaatatttaatcaatattagtatctttgaatagaatttatcctgggcacttgctagttattatttgtccgggcgtgatggctcacacctgtcatcacagcactttgggaggctgaggcaggtggatcacctgaggtcaggagtgcaagaacagcctgcccaacatggtgaaaccccgtctctactaaaaatacaaaaattagttgggcgtggtgatgcgtgcctgtaatcccagctactcaggaggcagaggcaggggcatctcttgaacccgagaggtggaggttgcagtgggctgagattgcgccactgcgctccagcatgggcaacagagtgagactccatctcaaaagaagaaaaaaaaaagaaagttattatttgagcataatgaaaaagagaacaaaaattagggacaactttcccttccaactttccagaattttcaaccggtacaaaccataaagttttataactgcaagtgtctgaatgcctggcccacagtcactcagcagggctgcagcagagtcatgacttgaacccaggcttcctgaccttttgttccatgttctccttgcatcgtttacatgtcagtgtctgactccgcttaacaaaatagtggaaaaatactttgcacagtatttttgaagccccaaattcaaataaaaggcataaagaagtgaaaaattgtagttattttatgaattctcaagtaaaccactgttgtttgaccagaaattgtttattttcaaaacaataaagattcacctaaaacatattctgtttcatgaaggaaatgtgacaacctattcattacagtcagttaccaatatagagagctgttcccaaatgtttagaattagctggactgtctactgtagacacagaatttattttttaaaaaactctctttccgagagtttcagtgctttcagagcactgccttttgtttctttgcctgacgttggtgttttgccaagtgctggtatttggaggtttgatggacagcattcgaagtgaggcatcagtcttccttaatttgttcaaagcctctttatgcagcagctaatccttcctaattatatttctaggaaggatgttcttaactcagacgggaagaagacatagacattttgacattaggatgcacttcactccaagaaaagaaatttgaaaggaaacactctcccaattcccattccttaccccctgggcacaagcaaccattttcccctgccccatttatgaagctcttttctctccctctccattcctctttcattcctgtggctcctatttatctcctggcttaatgaagctattttgaaggagctaaaaaaaattcagaaaaaaccatttccgtgtagtgaggcaggcatttcacaccttaattgctttaacgtcttgaaaggtgaaaggtgacctgtgagtctaaacagttggaaaatttagtgtgcatatttgaaatgctttacataaagttgaaacacttcacagtctccttgattaatttctttgttgccgtgctgctttgtattaatttaatttagtgacttttatgtgaaagtaaatatgtaagtcagtggcattatgtttattagattattttcctttaatattttaagcagactaaatgcggcttctgtcaaatgagtctttaataaataaattgctgtctgtgaagtcttagtggctttgaatggtcttatgaagtgtgatcttatcaccttatgaagcaattttgtgtttcttagttttttttagtgaggttgaacattttccacatttttataagtccttcatattttttatgtggataactaacatcttcacacccttttctgttacatgtgcttataattttctttaatttctaagagctcttttcatattaaagattgtttttatcaaatatttaagaattctccaagggaaggtacttttatgcaaaaaatattattagtactctggttttttttatgctcaaatttggaagaaacgtcttaaattggattgtaaaaaatccccccttgtccatgaggacaagaatacaatctgttactcattgactgggtaatttatttcagaattctttggtcttctgagaggcttattgacttacacagacataaatcgtaatatactactgaaccatctataactttccaagttctctgtgcatttctaactggttgcgttatctctggttcaccatagtgaagatagaatctcagtcctcctggcccccagaacacagattctcaatagttgattcattcattccatcagcagatatttactgagtgccatccacataccaactactgttctaggtactccaattggagggatcaggctaatgtgtctgcaaaatactgaataacatagcataatacctaataagctgctaaactatgtggtgcatagtataaattctaatggcgagtaaggaagggggagattggcaggggctggaggactggactaaaggaacattgaccagagttggaaggacttggaaaagtgaaggagagtctggcctttaaataaataacaggtggacgatagggtgggaatgattctcctgttggggaattgatctctttgtggggattgaagaatagcaggaaatgagattgagtgggcaggtccaattatggaaagccttgacagtcagacagaggagctctgtgtagggctccgaggaatatgaagatggctctgatagtcactgaagaagtgtcaggctcaccctggaaagccaggtcaggtggggtgctaagagagtgtgagggaaggcctgggaggctggctgctgggcagatgagagagagggaggcctagaggagctggccctgtggagtgtctgtcttgcacagggacttgagaggagagggatctgattccctttaaaacaggaaggattcagactgccagtcaagaaaataattcctttggattcgggttaaggaattatgtgtagtctaatgttgatctctctctctacctatgttaaatggaatgatatgtaatcttatcctctttaggaacaggaaagtaggggatatcattgaaggcttcctgttccttattacactctatccctagactcaaattcatcaacccataatcaaaaccagatttgatttccttctgtgttgatcaaactaacacatcatgctctgtagaataatcaaggtcttttttcctgtttcaaatgttcaagagttttctacctttatctttgttggctttatagctttgccataactactttttgttatctctacccctatcgatatcaacttccgtgtatcttctctgtgtttttcttgctacactaggagtgatccactcacctatattcctcctcctttaggtgacagaagtcctacatcttgattatcctgtattggtgaactggaaaggaaccttgggtaatcacacacagatgtataataaccaacaggttgttaggctctaaatgtcttcctagctggactgcattctcattagttattatttaaaataatataaaataagtaacagtatgacacaaaaattgcatatgtatttgatactattaataaagcagtttttgtttcagacttatattcatttaatttagctattaaggtctaaagttgctaggaaagtttttgtgatttgctttgtgaagtagtgtagtaacatgctgcttgataaaaataatggtaattgcctttcacagaatcagaaatgcttttcatacctagtgaggaaatgctatacttcttttaaaaaacttacatatccatatcagctttatgttcagattaatttaggatgttcataaaaaacaaggatttgatcaagctcagctttatgttcaaataatttaggatgttcatgaaaaacaaggatttgatcaagctccattaggaagtctttgacaagaaaccaaaagaaatgattgggactttcaatttcacatgtatttgttgaatatttactgtgtgccaggcagtgtgctagcagccaaactaaatagtctttagtttcaatgaataattgataactggaatgtttcttccatcatttctagtgtaagtggttttttttttcatttttagtagagagctatattttcataggacaaaacatgtaatactgtcccctctgttgatattaagtcagatattttatctgttcagtcaaagcccagttctggtgttaatgggcctggatttaattaattaaaggattaacttactgtatcattacctgtgtgcaccaggcacccttctgaattgcagacagcatgtaggaagatctaactaaactttaaccttacaagtacaaaccacttctaggtgttctcaggtgtgaacaatcagatgcaagcgggaaagagatcagaaacactgacaataataatgcatgaaataatagctcctgtagagttttagaagaaagggttgagctgactatggtgggggaaaaaagggacttttttttttttttaatgtgtgtgatgttctacagaaacagcaatctgaaagctaactggctgcagctggatggactttcttttgtatggagacgctgcctctagtgtttaggaaaaaatgcacactagaaaatagtgcaacattatggtgccatctgtcttgaaaatgaattattttttattgtctgctttatagtagttcccagacaaaacttgaaaaaacttcaactagctttggtgctattttgcgtatggacagtttcagcaggcagaagcctttaaagttgtatttcaaagcgcctcaggagttatcgatgtgatgtgatgagactgtttgccatataagcctctcaagaggccacagccctaaccccctccccggctccctgggggacaggagagcagatggagtcgtgtttgcatcattcaccgtcctaattgggtttgtgactggctgttagggcatctttctctcagatggcattttcttctttaattcaaagtttcactttctccttagcagcgttctggattgtttttgagggaatgatggcatggatacgcaaatctacagagttagaagaaagagacgagacttgaaggattgttgttctaaaaaaaaaaaaaaggctaaaatgcatttatttctcagacttctttagaataagtgcaaatgaaaaagaatactgaaaacattttcagaacccatgaaaacacttgtcggtattaatataattaaggtatttaagtttaaatgtttaaagctgatctttgaggtgttttagctgggcttctacttgaaattttgtagtgtgaatgtatatcaactatttataaactagctgaagggagttaagctattaatgtttggattttaaaatctataaggatcagaaaatgggttttgtattccatatcatctagaatgatgacaggcctggaagcataggacagagctggcacattttcaaaggaattcttccctggtctggatactataatgagcacaactgcattttggtggatttattatatacagtacacaacatatataaccatttggaagttgggtttgctttctggttagaggtgcactggttatagctgattatgtatagggtttgaaatagcatctggttaaaaatttgaggggctgacatttcctctcagagactggtgaaaatgaataaatacgcaatatggaaatatccatgccaatcaattagtagaagggtttaaataaaaaaaaaaggatgcaatttgaacatttacgattatgccagtgggcagcaggtggcaagctttgcttttcaatgttcttcagttttatttttataccgcagaatgccaaaatttgaagaggggggtttaactccactggaatatgtcatttcttggcagtgcaacctcgaaccaccttctttgctcattgtgcataattgcctttctttggatgccgtagccgacccttggttccccttgttgccgatggataggaattaattcatatgagcaatgttctattctcttgtgattttagcaacacgttgctaatggagaaaataaattagaaacaaatgagtttcttaaagcagtccttgtatgatttataagagattttcttgtgtagttttacttagttctaaatgacacataaattgcttttaatttaaaaaattctaactggctatataccttgatatggagatgagaagtaagcaaaactgcgtagagttccatgaaagtgttttgaaaaattagagaggaaaaacacattttgagaccagaatagaagaccattatcttttcataggctaaactgtgtagtcaggatttgaattttaaatccggaaaagagagcaagcttgaaatgggagtgatggtgaggtggacaccaaattattttatagtctactgtatttcttcatactttctagataaaaaattctttttgggttgttttatgcattgtgagaaattcggaagaatggagaagaatgcaaaagcatatcaaatcactgtaaacatttaatagtctacaaatatttaacacttgctgtgtactcaattttttgtaggccgtttgttagaattgagttcacatggggtataattctacgttcacgacttgacattctcaacctcagttcagcattttttctttttagaaaagagatcgttcataatgattataatttacaacacacatattttaaaggatagtaataaaaaaacccaaactgttgtacccactacgtagctgaagaaataaaaacactgttgtcattatcttagaggctcttacgtggtccttgttaattcctttatccttttttcccagaaaataatttatatcagttatttcctgcttttctttatagtgttaccacatttttaggtatatctggatactgtgctgtttagtttttgacttttaaacaaatgtcatattgtttgtattcttctgagacttgcttttcttgctcaaggtgtttttgacattcttctgtaacagtggctctcaaactggagcatgaatcagaatcgccggtggagggcttgctagataaaatacggcttgttgggccccacctcagagtttccgatttggtgggtctggggaggggtggagaatttgggtggctgacaaactcgcaggtggtgccaatgctgaatgctgctggaggggtctgcactttgagaaccactgattaaagctggggattcttttactttttacagtagcccattatgtcagtatactacaatttatcatttctactgataatgaacactgggttgtttttagtgttttgctgttacaacagggtcatgatgaacgtttttttttttctttttttgagacggagtctcactctgtcacccaggctggagtgcagtggggcaatctcagctcactgcaacctccgcctcctgggttcaagctattctcctgccttagcctcccaagtagctgggattacaggtgtgtgccaccatgtctggctaagttttgtatttttagtagagacggggtttcaccatgttggccagtctggtcttgtactcctgacctcagttgatccacccaccttgtcttcccaaagtgctgggattacaggcgtgagacactgtgcccagcctcgtgatgaacatttttctacaagtcttctgttgcatagtttaaaaagcttttttagcatgcaatagaaaaatatcaaaatgcttccctcatattaagggtaggtgttgtttcatgaaacttttgtttttggaacacacactgctatgtaaaatggctttcttacagtgaactcgtcaaaaaatgcttaaaagcctcttgtccagagtagttacattgatcatgctttctttataaaatgggatccatttctatctcattgctatatttttctagattttcttctaaaagctttttctttcacatttcctgtaatgtacctggaaatgatttttgagtatgtgtgattttttttccatatggctaacttattgtcttagcactatttattgactaattctccccctgtccctctcataaaaaaaattataaaaaactaccatatcatatatgtttcattcaagtttctaaatatgtaagtctgtttctccatcctctatcctactgtgttggtcttttgagtatccttaagtcagtgccatgctactgaaagtgctgcaattgtgtagtaagtcttggaaggtgtaataatcatctgtgtctcttgtgctgggttctggctgatttcttctagtttattaatctgctattctgttatacccactgtcatcttttcaagtgttatttattttttaatctctgaaagttctatttgactcttttcaaatttccttagtgtatgttgtcttattatttagtcatatttttgacctctttctacatattaaatatacattgtgtatcttatagttgcagtcttaataatctacagttgttactggactgatttggcacttttatttttcctctgattctggcttgtttccttgttcattttgtgatttctgattgtgagtattcattggaattttatttctagaattcctgaagatatagtttttattttatttatttttttgagaaaaggcctcactctgtcgctcaggctagagtgccgtggcatgaccatggctcactgcagccttgacctgctgggcttaagcaattctcccacctcagccacccaagtaactggagttacaggtgtgtgccaccatagccagctaatttttaaaattttttggagagatgaggtgtcattatgttgcctaggttggtcttcaactcccgaactcaagcagtccccctgccttggcctcccaaggtgctgggcttacagggcatgagccaccgcacctagccaagatcctgttttaaggaggattcctacagaggagagcacttgtgtctgcttttaacaagtctcctagtggggtactacccattcaggttgcttttaattaaatgttggggttattattgttttgatcactcagatactttttaatttgaatgccaaaccaacataaaggcgaacttgtgggttaggaattctcacctgagatttatgctgttgcttgttttcgtgtttacccaaagcccaaactaagacagatgcgactcctcctgttctctcagcagtgcagtgtttggttttttggtttcccctgcagaaagttttaacacgagggtttctgatctaatcttttaccttatgcagcaccaagctttgtctctgtgccccatgaagcatgttaaaacctgtaatctaggcatccagaaatggcagatgcccctccagggaaaattcctgttctggagccaactcatttccctggattcatgctctctggtcgttcctggcctgtgaagatttctcttactttcttgacatctcagccatattttatattttgtccagcaatcttagttgttttatcctggcaaattttctctggacatcttatcctctgttttgccagaattagagatcctagttaatttattttaaagagttcgagttctgagaagtagaaaatatttggaggctagaccataaagtttcctgtgctgcaaggaacccatagcactgttgaatgactatacgcttgagtctttggaaagactcagatgttcttttccttgtcatttatgacatgagaagtcttaggaaaatgtctttttttttgccagagcctcatctaaccagtggccagtgagcctgggagatgtgtaggatcctctggggctgcttctcgcatctctgcctctgggtgcctgcctctgggcacctgcctgggacatctgcgctcagggctctgcctccagttcccgccctttgtctttttgtccccagcctagttgtgaaatctcatctcctggttcttcattttgctcagtagtttcatttgggcagtctctagctctcacaaacatgtactcgaagagtactgattagtgtgttcagaggttaaattggcctttgtgtgttataatcccactcttctctttgagggtttgatgagagaaaattgaagttctgttcattatcattctaggaagagtaaatggatagtaatttaggggtaggaaaggggcaaatgcatagttgttgcttttactccagtagcatctgacaggagaaaaaaaaaacaccaaaacccataattgttctttcggagagagaaaccccacctgtatatattttttaagctgtaaatactcctgaatgaattttggtagctttggtagctataaggggaaacagtattgtatccatcttgagtgtccttcttacctcttatactacatttatcatctttaattctgctttagactcatcccttgcagtggccacctgtaacttggcagcctgcagggcattgccaaatatatcgagacaccaagtaaaatatcttttgtaaccaaaattaaaatcaactatatttttggctgaccagttctaatcccagacttgtctaaatcattgagaaattatatgttgtgtttgtggggggccataataatataatcatagtcaattaaattaaattgagggagtgaatggaattaaacatttttttttaccctgtatttctttttcaggaatctgagttggaatttgataaccatcagtttattataacagggtcagtactggagtgataatgggttcggaaaggcaggttctgggcaagggaaagctgataatggttgcttacggttgaggttttagatgacgaagcttggttttgtgtgtgatttagattgggactgcaccaaaatgaggaaggagagtaggtgtaaaatctcgggagtgcaggggaggaatcaaggagcagccagaaaagagagatcgaatgggaccggttttggaatctgggagtggttggggaaggctaggtagagtagggcatggaggcccatagagatttcattccttggtatggaagaaaaatgagcaagagttacttgaagggtaagcagtggtttgagatcctgggtcttgattatgggaggcagtaatcagtagttagtgagatcctgaaagcaggagagggctgctcagagagaattcacagggcatccaactgtgagtgtagacccagatgcttggagcagtgggtatgagaaactcaagctcctgagagcgctgtctgccaacacacatgacgattagcagacccttcctggtggttaaggagctcacaggtcagtggaagacatacctgcattctgcgcatatgtgtacatgcatagaataatatttctttgtaataaaggtaatgagaggagctttgcagcaggtgatctgggagttccaagaagagggatgtgccttttcctactccacagaacctaaactcatttcaaagcccttggtaaacacgttcatctactgcctcctcaaccacatatgtcactgctctccaatccacgcctcactgtctcttccctcttcctgctccttttctgctccacactttgtgttcctgcctgtcatatcctcccttgaatggtaatgtcaggtattttgcatgcattacttgtgacaggagacattcagatgattgaactatttactggacagcacaggcatagagcagttggaacagagccggctgcagtgcagggtcacttgcttttctggaggttattcccttagtgcttgtgctgtgtggcggggaggtctgagggaggtttggtgggatgataatgacacctgggagactcaggatagcagctctttaccatttgctatggaagaagtctgacaattttacaatggtcacactgtgctggtacctaccagctgactgtcagactgcctcacaactaccccaccgttaataccttccttttatagatctggaaaattagttttctttagaagagtcaagtaacctgccaaaatgacagctagtaagtgagaattagacttgaacccaagcctgtgtgacctcaaagaatgattaagaggtctctaccaccataccacatagcccaccgagtagagtcttgtgttgctcactgtcttgtctgggtcaggcctctttattatttgtttatttattttttctagctagatggctatctaaagatacagactgtgtcttttctttttctttctttttttttcttttttgagacggagtctcgctgtgtcgcccaggctggagtgcagtggcatgatctcggctcactgcaacctccgccgcctgggttcaagcgattcttctgcctcagcctcccaagtagctgggactacaggtgcccgccaccatgcccagctaatttttgtatttcagtagagatagggtttcaccatattggccaggctgttctcgaactcctgaccttgtgatccacctgcctctgcatcccaaagtgctgggattataggcgtgagccaccgtgcctggcccagactgtgtcttttctgtattcccagtgcctaatctggaatggagcacatgataaatagcattcattcctttatttattctgcaaactcttaatgaacacctgctatgtgtcaacctttgtattagggcataaacagataaataaggcaggatagtcacccttaaataacccacagtttactggaagtctcagtctctccctctgtctctctcttgctcacacacatatataattataatgataaagatatgtaccagatgcatctagttgcatttatttgaagaggtgaggtagctgagagtgataatggtatgtgtatcctttacaggatactaccaaactgtttgctatagtgactataccattttgtttccttaccagccgtgtatgaaagttttagttgctccacatcctcatcagcacttagtattgtcagttttttctttgtgccattctaataggtgtatagtcgtagctcattgggcttttaatgtgaatttttctagtgatcaatcttttcacatgcttttgagtatctttgcatatgcgtacttgccatccatagatcttctttggtgaagtggacctttagcccatgtttttaattgtgctatttattttcttacttgttgatatgactaacttttaacagaactttcttttcaggaatttgttaattaggtttcaagtacatttgatataaacagtttataaaatgcttcaaacaacatgctctaggagtggttgccagggaaaactaaaatggactttgatcccgactggggcaagagtgatgaagatgaggttttttctgtgcttttcctcagtgtgattttgaaacaggaggacagagcaaagggagagaaataggagccaaaaagctcaggagggactttgatcttcagtctaaaagggaaaacagggattcttttggttgccagtggaagctggaaggattagacatgccaaagggatggtttactctgatgagaaaagcaactggacaacaacagcaaaaaacactgcaaggcccaattcccatccttttcagcccaaaattggaggaggccagaccaatgggaggtttctgtcactgaagatgaggtcacattattttgtcatccagactgatctaagcagatacttttaggaaaggtaagaatgccttgatctatgcctagatatttacaataggcggcaatttttgacatttatgttgttacgctaataaattggtattttttaaaaaaatatttggctgattatgtaaaaactgttttgggaaggagtctatataaagctaaaacactccctgcctcctgtctctgacttgcaggccttgtgccattgggaaaaaaaacagccaggcctatggtttaaggccttctgggcatctgactacctgcaccccagcactgtctacacagtttgtgtacatgagtatttttatggggaatggttacagagctcttctcagcctcagggaggcctataatccccaaacggctgtgaaccgctgttctagagggtgagattggcaaattcactacagtgatggcacagcaaatgttccatgtctcagcttgaaaacattatggcaggaagtcctgcgtcagatgaaattaggtatacattaaagtagtgggattgagcccagagccttttcaactcttgtatataacagctttgattctcttcctgacataatgagtctataataattggtcaagaattttttttttttacttattaaaagaaccacctcagataatatgttcctgattatgtaactataattataaaaaatcgtatattattgtgtttaataaaaaccaaaatttataggctgggtctaatatatgcatcttgccatgctatattttggagaagacagtagagtgtaagctatgatctttttgagaagacaggagccacgtgcgcagaccatgaagtccagaggagggtggtggagggagagagtgtttcaggctagaatggccggttttagctgtggatggaaaggtagtatttgatggaccaagaggagaggaaatctgtaagcaattgctcagaggaggaggaagtagaagaaggaatttggctgagcatgttttacatgaagtattcctattaggggagtagccataagtgagggtgagaatgcaacacaggtgaaataacattttgggaaatttatctggtggtggaggaccaggcggtggaggaccaggcatagagaagggaagagactaaaatgagagacggtgtttaaatagttaatgcaatcacatagtcatgaagagggagggcttaagcaaaaaggaagggatagctaggagagcccttgtagagggtggagaaggcaggctgtgccctattcaaggaaagggaggcagtgggtcaggtgattccactgactcttagactctatattcacagtatagatttctgttcgttttttttttttcttcaaaagcctttaaaaatgttcaaaaggaaagcatttagaccttttatgaaatagagttgttaaaggaaaaagtatttttttttttaattatactttaagttctgggatacatgtgcagaacatggcaggtatacacatgccatggtggtttgctgcacccatcaacctgtcatctacattaggtatttctcctaatgctatccctcccctagccccctacccactgacaggccctggtgtgtgatgttcccctccctgtgtccatgtgttctcattgttcaactcccacttacgagtgagaacatgtggtgtttggttttctgttcctgtgttagtttgctgagaatgatggtttctagcttcagccatgtccctgcaaaggacatgaactcatccttttttatggctgcatagcattccatggtgtatatgtgccacattttctttatccagtctatcattgatgagcatttgggttgattccaagtccttgctattgtgaacagtgctgcaataaacacgtgtgcatgtgtctttatagtagaatgatttataatcctttgggtatatacccagtaatgggattgctgggtcaaatggtaattctggttctagatccttgaggaattgtcacactgtcttccacaatcgtttaactaatttacattcccaccaacagtgtaaaaatgttcctatttctccacatcctctccagcacctgttgtttcctgagtttttaatgattgccattctaactgggatgagatggtatctcattgtggttttgatttgcatttctctaatggccagtgacgatgagctttttttcatgtgtgttggccgcatgaatgtcttctttagagaagtgtctgttcatatcctttgcccactttttgatggggttgtttggtttttttttcatgtaaatttgtttaagttctttgtaaattctggatattagcccttgtcagatggatagactgcaaaatttttctcccattctgtaggttgcctgttcactctgatgatagtttcttttgctgtgcagaagctctttagtttaattagatcccatttgtcaattttggcttctgttgccattgcttttggtgttttagtcacgaagtctttgcccatgcctatgtcctgaatggtattgcctaggttttcttctagggtttttatggttttaggtcttacatttaagtctttagtccatcttgagttaatttttgtataaggtgtaaggaaggggtccagtttccgttttctgcgtatggctagccagttttcccaacactatttattaaatagggaatcctttccccatgcttgtttttgtcagatttgtcaaagatcagatggttgtagatatgtggcattatttctgagacttttgttctgtgccattggtctgtatgtctgttttggtaccagtacaatgctgttttggttactgtagccttgtagtatagtttgaagtcaggtagcatgatgcctccagctttgttctttttgcttaggattgtcttgactatgtgggctcttttttgtttccatatgaaatttaaagtagttttttctaattctgtgaagaaagtcaatggtagcttgatggggatagcattgaatctataaattactttgggcagtatggccattttcacaatactgattcttcctatccatgagcatggaatgttttttccatttgtttgtgtcctgtcttatttccttgagcagcggtttgtagttctccttgaagaggtccttcacatcccttgtaagttgtattcctaggtattttattccctttgtagcaattttgaatgggagttcactcatgatttggctctctgtctgtctattattggtgtatagggatgcttgtgatttttgcacatcgaatttgtttcctgagaatttgctgaagttgcttatcagcttaaggagattttgggctgagacgatggggttttctaaatatacaatcatgtcatctgcaaatggagacaatttgacttctctcgtcctatttgaataccctttctttctttctcttgcctgatttcactggccagaacttccaatactatgttgaataggagtgatgagagagggcattcttgtcttgtgatggttttcaaagggaatgcttccagtttttgcccattcagtatgatattggctgtgggtttgtcataaatagctcttattatttggagatattttccatcaatacttagtttattgagagtttttagcatgaagaggtgttgaattttgtggaaggccttttctgcatctattgagataattatgtggtttttgtcgttggttctgtttatgtgatggattacgtttattgatttgcatatgttgaaccagccttgcctcccggggatgaagccgacttgatcgtggtggataagctttttgatgtgctgctggattcagtttgccagtattttatggaggatttttgcattgatgttcatcagggatattggcctgaaattttcttttttgtgtgtctctggcaggttttggtatcaggatgatgctggcctcataaaatgagttagggaggtgtccctctttttctactgtttggaatagtttcagaaggaatggtaccagctcctttttgtacctctggtagaatttagctgtgaatctgtctggtcctggacgttttttggttggtaggctattaattaccgcctcaatttcagaacttgttattggtctattcagggatttgacttcttcctggtttagtcttgggagggtgtatgtgtccaggaattcatatttcttctagattttctagtttatttgcatagaggaagtcaaatagtattctctgatggtagtttgtatttctttgggatcattggtgatatcccttttatcattttttattgtgtctatttgattcttctctcttttcttctttattagtgtggttagttgtatatctattttattaatcttttccaaaaaccagctcctggattcattgattttttgaagggttttttgtgtctctatctccttcagttctgctctgatcttaagttatttcttgtcttctgctagcttttgaatgtgtttgctcttgcttctccaattcttttaattgtgatgttagggtgttgattttagatctttcctgctttctcttgtgggcatttagtgctataaatttccctgtacacactgctttaaatgtgtcccagagattctggtacgttgtgtctttgttctcattggtttcaaagaacttacttctttctgccttaatttcgttatgtacccggtagtcaattcaggagcaggttgttcagtttccatgtagttgtgcggttttgagtgagtttcttaatcctgagttctaatttgattgcactgtggcctgagagactgtttgttatgatttctgttcttttgcatttgctgaggagtgttttacctccagttatgtggtcagttttagaataagtgcaatgtggtgctgagaagattgtatattctgttgatttggggtggagagttctgtagacgtctgttagatctgcttggtccagagctgagttcaagtcctgaatgtccttgttaattttctgtctcgttgatctgactaatattgacagtggggtgttaaagtctcccactattattgtgtgagagtctaagtctcttttaggtctctaagaacttgctttatgaatctgggtgctcctgtattgggtgcatatatatttaggttagttagctcttcttgttgcattgatccctttaccactatgtaatgcccttctttgtcttttttgatctttgttggcttaaagtctgttttatcagagactaggattgcaacctctgcttttttttttgttttctatttgcttggtaaatattcctccatccctttattttgagcctatgtgtgtctttgcatgtgagatggaaaaagtttttttttaaaccacaagggatgaaccttgcataaattaagagccgtagcattgttgcaggcattgtgttgttacctgacaccattttggagtggttgattcagagatctgttgtaaggataagaataaaacagacattcagaagcagaggaggatttcaggcagtgactggtcttcatggaaagagatgaagagcgcttatttagtacaaggagctgtgtgactgtaactgaacccattccttagagtactggctgagtgctagcaggaaagacatccagaaccttcagaggattctgggagtgcagtaaaaatccttcaaatttctcttggagaggaataatcctgttgtcttctaatagtagagaaaaacaggtgactggattagaagtggttattaaagttaaatgttgaccaggcacattgatgcctaatagcattgctttccacagcaaagtactcacactcagaggagcatgagacattccactaaggctgcaagaagaaaaaaaagaatagatgttgtacttatgtttacttctgtctaaaaatagaaatcaacctgtataatagtcgacatccagactgaccctggtccttcctgtggtccagatgccagaagatctgcagccttgctcacagctggacatttcgagggaagcgtgtgtgctccgttgacaggggctgactcttcagagaggattatctctacctgattaggtagacttacagatgataggatattaaatagccaaaaaatcttacagtatttaataatgagattgagaatgatgctgataatctctaataccacagatgctaatgagcagatatcttaaaggaactgttgaatgtgagttaagaatgttttttataaaagacaaacattttgaaattgctggccttctgcatgatatttagctatgagtggtcttgttgccctgcagataatttaaaagttaatactcataatctgtcctttcaaagtagaggtgatacattaacaatgaataagaaagtaacctttaaaaaaatctggtgatctggtgctacacagagagcacttgtaaaataaatgtacagaaatagttccattgtgacatgattttcattcctaaaaacaataggtgtgcgttacatgttaactcatatttgcatacttaaaaatattggaaacaaactaaaatcttccggagagtttaaaacccaataaaaatttgtcaaaatgtaacattttccaataagtttgtaagaccaatgaaatgacattggggaaaatggaaagttactaattttagccaaaaagcttttgagtagttagtgtatgagattgaaatatgagtgttatgactttgtaagtacatttcttccatttgcatcaatgtgtctttttcaaatatctcttttgagctaggccggacactaaaactaaatattaacatatactggacttaaaatgagacctctgaattgccatatcagtaagtgttaaaccaagattaaaaaaatgaaacccattcaatcatgccgcagtcactaagaaacatttttagtgataaaaagggttaataaaggaaaactacttaaaaaaatttaaatttcatttttatctcagccttccaaatttctatttttgagtatgttttgtgatgtacatattgtatagacagtgtagttttagaatatatactcaatcagaagtgttaacagcaaagctagaaggaactttgagattctctaatcctggtatagaacatgcatataatttgtaaataatgtatattttggaggttaggcttttttttttctttttttttgttttgaatgagacagagtcttgctttgttgctcagcctggagtgcagtggtgtgatcacagctcactgcagcctgggactcctgggctcaagcgatcctcccacctcatcctcctgagtagctggaactataggtgtgggccactgcgcccagccaatttttacaaattttgtgtagagccagcatcttgctttgttgcctaggttggtctcgaactcccggcctcaagcgatcttcctgccttggcctcccaaagtgctgggattataggcgtaagcatttttttttttttcttttcttttcttttttttttttttccctagaacggtgtatgatccaaataggtggccattggtctacagacaaaaacctgctgagaaccttttaataaaatcatcctggtttctgaggggttgaggaatgttctgtttccaagcccaggactcttagaaactatctgtagcacattcaggtgacaatatgggttgagatgtatctataggacctaacaggtagaggaacttctattctttgagtagatgtcaaaaggtaaaaagtaggatcggaatctttctccatgtggagaaatttcagattccaagaaagagtacacacaactcacctgtacattagacaccaaaaaaatgctcaaattaatgaactattatggagtatttaaaaacatagagaactctgctttaaaaaaaataggagaggatccttaagtttaaagcaaagtagtacttcaaaacttcattaattttgaagtattactctgctacagatagtgtctaagagtcctgggcctggaaacagaacatttgggttcaggtttcctctttattccattctggctttatgatcctggcaaattattgaaactctcttttttttttttttgagaccgagtctcgctctgttgcccaggctggagtgtaatggcatgatctcggctgactgcaacctccgcctcccgggttcaagcgattctcctgcctcagcctcctgagtagctgggattacaggcgggcatcaccatgcccagctaatttttatatttttagtagagacagggtttcgccagactggtctcgaactcctgaccttgtgatccacccaccttggcctcccaaagtgctgggattataggtgtgagccaccgcgcccggcctgaaactcttgaggtttcctcagccagaaaatgagcatggtaattcttcacaccatgattgtgaagctccatgagttggggcagaaggaagtgctgtaaaaactatagtccccgcccgttgtggtggcttgtgcctgtgatcacagcgctttaggaggctgaaggaagagaatcatttgaggccaagagttcgagaccagcctggtcaatgtaggcagacccagtctctacaaaaaatacaaaaattggctgggtgtggtggtgtgtgcctgttgttctagctacttgggagactgaagtggggggattacttgagtccaggagtttgaggctgcatgagctgtgattatgccactttaactccaacctgggtttcagagcaagatcgtgtttctaaaataagaaaaaaaacacacacacacacaaaactgtagtcctctgcaatattactgagtgaggattgcccgagacttgagaggcagttaggcagcccccttcattctgactgtggtggtcctctcctaattgagactgagaattctctagatgtgcctgttaaatatttgcatggccccggagtgccattcagagctggattttgtttctgatggctcagttgcccttgaggctgctcttgggttcccagtgcttgtgttgccaagttgtgtgaagtgtgcagagctgctctgggtttgcagagctggcttcatgtgttgtggagagggccctgagatgttggtgactcattcaaagccactttatgtctgcttctacatcttgctcaatctgctaggcttactaccatctaagtcctagaaggcctatcaactctccccaggaaatgtagaacccaaagacataggcacatactttcatttcctttttaaatgaatacagtctctttaaaagttttatttgaataccgatccatggtttgcacaagccatttgaattttaaacagatgtgtgtgcaaagctgggagtcagcattgcatgtctcagtcaagttttatagtcattgacttttagggttacagcctggtctcatagctgtgccttgggtggaaaggctggtaaggacttcgatgtactttcctgtccagagttttgagactttagccaggactagggcagctttctgggtgtccagtggagggccacgtcattcgaccgttgctatgggaaaaacccatgagctctctcattccaaagtttaccgattgccaaatacttgggtgtgtggtatttggaaaaaatatttagtgatgcagtgattctttgaagaggtgtcctctaatgtttactttttaaaatggtaaaccaattttaatattgttcatacctagctaagactgaattagattatttaaacatatttaaacatcatctctgtaagtgaatgggaaaataggaaccagaccaaacccctattattgaacgctaagagaaatggatttttttaaaaaccgaaataattaaaatctagtgttacatgtgagtctagggactggatttactatttggcaactacatattttgttggcaataaacttattgtctaaaagaaaatgcgtagagccaagatagaggcccaagtaaagaagaaagtgtgatcctaagggaaattggtttattgaggagaatgtatcttcatatactatttgtaagttttctgtatggaggatttctcccttttcacccttgtatttatttaatcgtttagttgtagtaccttagcctcatttgttttattcttcaggttatattattattttcttgctcaaattgttccatctttagtcattgtaagctctttcaggttgactcccggatcaaaatatagtttttaaaacaggcttttttttttttgagatggagtctcactcttgtcacccaggctggagtgcagtggtgtgatctcggctcactgcaacctctgccttctgggtgtaagcgattctcttgcgtcagcctcccgagtaggattacaggtgcataccaccacacccagctaatttttgcatttttaatcgagacggggtttcactatgttggtcaggctcgtcttgaactcctgacctcaagtgatctgcctgcctcagcctcccaaagtgctggaattacaggcgtaagccaccgcgcctggcctaaaagatttcagtttttaagggcagttttaggttcacagcaaaattggagaggaaggtccagacttcctatataccctggcccctgcaacccctctccccgtcccataggcatagcttctcccattgtcaacatctaccagagtggtacatttgctacaaatgatgaacctacattgacacatcattattccccaaagtcctagggttcacccttggttttgtacattctgtgggtttggacaaatgtataatgacatctatctatcattatagtatcataatgagtattattgaaaggtgacagcgtgctggcagccctcgcagccctcgctcgctctcggtgcttcctcggcctcggcgcccagtctactagatgagtatttgccgtctgggtttccttgattagaggggcctggctattttgctgtatccggggatccatagtcggcaaaagccagtaattccaaggaacccccacaaactgttttaatgtcttagggcaaggataagccagtataggctttattcattccttgctgagggccctggtccctctggctaagattaggcctagatatttgacctgctgtaggcaaagcagggccttcgacctagacaccttgtacccttgattagctagaaagttcaagagatctagagtagcctgctggcacgaggcttccaaactggtagccaaaattaaatcatccacatattgaaggaccagagtgcctggacttgagaagtggcctagatcttgggccagtgcctgaccaaataacaggtgagggctatccctaaacccctggggcaagaccatccacataagttgggacgtgtgatctgtgggatcctcaaaggcaaagaggaactgggagtcagagtgcaggacaatacagaagaaggatcctcgaagtccagaactgtgaaccattctgtttcctctggtatttgagagaccagggtataggggttgggtacaactggatatagaggaattactgcctcactgatgagtctaagatcttgcactagtctccactgaccgttcggtttttgtactcctagaattggggtgttgcagggactgctgcatttccttactcagccttgagctttcaaatgtttaataatattctgtaatcctttatgagcttcaggccttaagggatattgcctttgataaggaaaaatggtgggatcttttaacctgatttggactgggcgggcattttttagccttccaaattgtccttccaatgcccagacttcagggttgattccctcctcaagtaggggacaacaaatgggtaacttgttccccatattcatgtagataatagctccagccttggctaatatatccctccctaataaggtgtgggacttacaggcataacaagaaaggcatgtgaaaagagcaaagtctcccaattaaaactgaggaggtgtgagaaacacctggttacaggctgtcccaggattccttgggtggtaacggaccttgaggacagtcgtccaggacaggagattaacactgagaaggccgcaccagtgtccaggaggaagtcaatttcctggccctcagtagttaaatgtacccggggctcagtgagggtgatgacatgagccggtgtttgccccaggcaccctcagtcctgttgttggatcatctggttgggggcttctgacccagggaaccttcatcctctggagcagtgcaccttccagtgattgcctcggcatagtggacatggacgagggggcagctttttctcactggacagtcttttttaaggtgtcctagtaaaccacactgataacaagccccaccagatgattggcctgctccattttctgtcctctctgaaccaccaaggtttgtttgtctgagggccatgactaaggctgcagcctttctctgatctcgcttttccttttgggcctgttcctcttggtccttattatagaacaccgaggttgcaaggtttaacgatgcctctagattttgttcagggcccagggcttgcctttggagctttctcctgatatctgtggctgattgggtattaaacttatcttttagaatcaattgaccctcgagtgattcgggtgacaggggagtatgttttcttaaggcctcccatagccactcgaggaaggcagaagaattttcttcctttccctgagttatggtggacatcattgaataattcatgggctttttttctaattctccttagtccttctagaacacaggtcaacagatgtttacaactccagtccccatgatctgagtcaaggtcccagtggggatccatactggggatagcttgctgaccagtagggaatttgtccctttctttggctgtcattctatcatttacttgactaagataccaggtgtctccaaactcttgggctgcagctaaagccgcattcttttcgttaaaggccagggtttgatctaacagtagcatgacatctctccaagtgaggtcaaaggtttgccctagaccctgtaggacatctatgtacctatcaggatcatctgaaaacttccccaggtctgccttcatctgctttaaatcagagcaggagaaggggacatgtacctgggtagggccaaattcccctccccctacagcttgaaggggacataacccatagcccgtgggtttttgtggtcctttggagatttctttgcttatttccttctgggcaggggagatgagaggatgattatcattaataggaaggggagctatagggaggctaggatatgggggtaagctgagaggtcctcctgtgggatgtaacttgtaagctttgcatagttgtgtattctccctcaatgaaaagaaagcttggacataaggtatttcactccatttgccttccctcttacagaaaaagtcaagctgcaggatgatagtattgtaatttgtacttccctcaggtggccgtttttccccatcagagagagaatattggggccaagccgtagcgcagaaaaaaatgagccgcctctttttcagggtttgtgggtcgaattggtcccaatagcttaggatgcatttcaagggtgagcctgtgatgcctgagtgtttcccatctgaaagacaaaaccgcctgcagttttgttttgttttgtttgcatttatttgcttttggctttgtggctttcggttttctttggtaacagaatggcctggatgttaggcaaaatgccgccctgggcgatggtgactttgcccagcagcttgtttagttccctgttgttgcaaattgccagctggaggtgatgagggatgatgcgcgtcttcttcttgtcccttcgtggttgcaaaaatgtgtccagatttggcgggttcttggtctcactgacttcaagagtgaagccgcggaccctcgcagtgagtgttatagttcttaaaggtggcgtgtccggagtttgttccttctgatgttcagatgtgtttggagtttcttccttctgggtttgtggtctcgctggctcaggagtgaagatgcagaccttcgtggtgagtgttacagctcataaaggcagtgtggacccaaacagtgagcagcagcaagatttattgcaaagagcaaaagaacaaagcttccacagtgtggaaggggacccggacgggttgccactgctggctcaggcagcctccttttattctcttatccggccccacccacatcctgccgattggtccattttacagagagccagttggtctgttttacagagagccgattggtccgttttgacagggtgctgattggtgcgtttacaatccctgagctagacacaaaagttctccacgtccccactagattagctagatacagagtgtcgattggtatatttacaaaccatgagctagacacagagtgctgattggtgcatttacaaaccttgaactagagacagagtgctgattggtgtattcacaatcccttagctagacataatgatccaagtccccaccagattagctagatacagagtgccgattggtgcatccacaaatcctgagctagagacagggtgctaattggtgtgtttacaaaccttgagctagatacagagtgctcattggtgtatttacaatcccttactagacataaaggttctccaagtccccactagactcaggagcccagctggcttcacccagtgggtctcccactggggccgcaggtcgagctgcctgccagtcccgcgccatgcgcctgcactcctcagcccttgggcagtcgatgggactgggcgccgtggagcagggggcagctctcatcggggaggctcaggccgcacaggagcccacggtggggtgggggagactcaggcatggtgggctgcaggtaccgagccctgccccacagggaggcagctaaggcctggcgagaaatagagcacagagctggtgggccagcactgctgggggacctggcgcaccctctgcagctgctggcccaggtgctaagcccctcactgcccggggccggcacggctggccggcagctctgagtgcggggccgccaagcccacgctcaccgggaactctagctggcctgcaagcaccacgtgcagccccagttcccgcccatgcctctccctccacacctccccgcaagccgagggaggcggctccggcctcggccagcccagagaatggctcccatggtgcagcggcgggctgaagggctcctcaagcacggccagaatgggcgccaaggccgaggagacgccaagagcgagcgagggctgcgagggctgccagcacgctgtcacctctcaatatcactgtcttaaaaatcctctgtgctctacctcatcataaaagtaagaaacctaggagtgtttctctctttggtttccaattactttggcctgggataaactgggacttctcaattcattgcgggccatttaacagttaatgagaagcatttcatggtctttctaaaactcttgtagactaataatagctatgatgaagtatatagaaattcattaatatttataaaagtaataaacattgagtaatagaattatgttagcattaaaattcaattattaattacattattatttcaactaattttgcaaaagaccattgactataggttcttagaggctaaaagaaaattagaagtctaccaccccacctcctttgttttacagatgagaagctaaagcttccaatgtttaagtgatttgcctaatcgaagccaggaccaaaactcatctaataacgtctaaacgtagtaccttccactgaatcaaagagttgggtcttcctgttttccctttttctccccccttcttttcaagaattaatattctgaagtattttccagatatggaatcaccaatttataatgataaatatgcaagaagatcaagataaattttgtgtattatcttacatttgtgttttaaattgatagctgctatcaatggcatgttaaaaaatactttagtgaatttcatattttgatacagctttcagcacagatcagcaatttctctcaagttttttgattatacgtttgattccagaaattctgtttcactggtactaattcaatgtgtttactcttcttttgagaatggtaccttactataaatgtcgcaggagaaaaaacattgccatttaagctacagaagtgctgaatatgacctgcacgtgttgaaatggcagtgctgcgggagaggttggaaaatgtgtgatgctgtcttataattttagctcgggtttatgcaaatgtgggcatttatcttgttattttcacagccatacacatttactgccgcttgaagttatccttacaagtgatcttcattaaattaagtttgtcttacaggagcagaaggaaaaggatgatgtgaatttcacctttaaaaggcagcactaggcaatgcaacatttaagaagtgttttttgcctgtgcccataaaaagctataccactttgttgatggatttgctattttgtgtcctattaagtataaaatgtgaccatatattttggattccaaggtcttttctggtttgttgaacacattagtgcttatgatgatgatttaaattagttttaatgtacttgggtagtcaagcgtacagtgctttgaagccactaagggagaaaaagaagagatatttcagccttccccagtaatgagacccataaatcaaaagaacgaacatggaaacttcaagcaagcctagggatctaatttcaaacaccttaaaagagactccttttttggtttaggcttgccatgtccgtggtgcccagtggaagggctgagctgaaaaatttggataaaaaacagagaacctctataggattaaaacaatggagccagacgctctcagtgttagcctttggatttgagaggcttgtgtttaagaagtctgggcctgaagaggtggaaatacagggggtcagattcagttacagatacatacatgttcaaataccaaatacatgtcatttaagggaaccataagatgactttgcaagagggagacttttttccatgaaatagttatagtagacttttcaaactaactctgaagtgaaattttgagcataaaagcttttcagctgacaaagagaaatggcatgaatgtctgagaaaaaaaccagacacatccctaaaacaacagagaaatgccttctagactttagatacatctatggcaaataggaagacaagctatttctagacctctggcaagaagactggccttttactcagttcttaaagaaaatagctaagagaagtttggaataagaaatccaagttcttctacatgttgttggttcgggcaatgtcaaagatttttttcatagcttgtctcttggaggctgaccttggactgtgcacatggacctatttttaaactgtagactccatttcactcccacatattttacccttctactgttcaagtgctaaaaccagggattatttaagttagcttactctgttgcaggctgggatgagagtttaggattccaaaattgtgttagaagtgggttgagaggaaataaatgtggagaggctaaatgacagttgtgttatggatccttttccttttaatttccccctatttttaaaaaactcactggagtcctagaatacacacagataattgacgtatctctaggggtatttgcattcaaggtaagtttcttttgattttagtaacatgtggcttttgattattatggaggacaatttaagcccaaagtattattttgccatttaggtttgtatcttaatttgggctgtgctgaaatcatcttggggggtgtgtgtgtatgtatgtgtgtgtgtgtttgggggggatgtgtgtgtatgatatatgtgggtaggtgagatatggagggaggcagggagggaacttttaataccgttcgttgtactgaattttaaattcagatctgtgtgtgtgtgtgtgtgtgtgtgtgtgtaaagaaatgcatttgtcatggctaactgtggtctttaatagcaaagtgaccagagcatgaattattttcttattcaaagaaaaatgaggggatcagaagggccactggttttcaaacaaaaaatagtacaaggtttatgtttttaaaaaactcatgttatagtgattgaaattttcttgtttggcagccttttcaaaaattaaaaattatattactttttttttctgaaatagctcttgcaaacaattatatgaatcaaaactgaaaactaattgtaaccatgtatttgcttatatcagatcatagaccaataacaaggatgttttgcctggtactgaattgtagaaactggagttggtaggacacattcctttaactttgagggatgattatggataaggcaattgaagtatttatggaagataattcagtctatatttaggaaagacttcttttttctaaccaaatatggtgggttttaaaaatcttacatattacaagatggatggatgatactggtccatccattaatacaccctattttcttaatgcctttcagactaagatgcacacatcatgagtatatgtttacctataaacactttgtcatgcatgtcattaactagaggtcagtatttgcttatagtgttatttttaaggtaaaatttacagtgtactgaaatgtacaaatcttacatgcaccctttgaattttgagaaatgtgtacttatgtaatccaaaactctatcaaggtagaggacttggccagtatctaagttatctcatcagttttctcagtcctaccccagagacaaccactcttctgatttttttcaccatacttttcactattctagaaacttcatgtgagattatacaatgtgtacccttttgtagaaggctttttacttaccatactatttgtggaatgtgttaatactgtcgcgtgaataagcagttcattcctttttattgttaggtagtattccattgtataaatatatggcaatttgtttgtccagtcatctgttgatgaacacctgggttgtttctagtttggggctattataaataaagctgccatgatcattcttgtgagttttcctgtggacatatgctttcaattctgttgggtaagtacctaggagtagaatttctgtgtataaggtaggtatgtggttagctttataagaaactctcagatgttttttccaaagcggtttatcattttatctttctattaggagtggatgaaagttctggttgcaccacatctgggcttacagtatagaattgtcagtcttcttcatgttaatcattcttctgagtgtatagtggtatctcattatgtttttaatttgcatttccctgatgactaatgatatcgaatagcttttaatgtacatattaaccatctgtatattcccctttgtgaaatgtctattgaatatattgctcatttattaatcagcttttttttcttaatgagttggaattttttattagtatatatcctggatatcaatcttttatctctctgtctcatacacacacacacacacagcatttttttcctcttactgtgttagttttcttaacagtgtcttttggtgagcagtttttaattttgttgaggtctgattttgtatgattattgatttctgtgtgtcgctcaataaatctttgcctactctcaaattataaagatattttcctatgatttcttctagagctttgttgttttagcttctgtgtttaggtctaggattaactttgagttcacttgagtgtagtgtaaggtgagaatccaggatgcttcattttttttctttatactgatatctagttgttcaggatcatttgttgaaaagagtttcttttctccgttggaatgctttggcaccttttatcaaaaaatcagttgaccatatatatgtgagtctatttgggagtttccagctattctgttgatctgttgttgatccttatgctagtacagtaatcgcctctttatccatgagaggatatgttccaagacccccaatggatgcctgaaactgtggatagtacaaaaccctctatgctatgattttcgtatctgataaccaagatagctactaagtgacgaatgtgtgggtagtatgtgcagtgtggatatgctggaagaaggtgtgagtcatgtcccaggtgggacacagcaggacagatttcacactactcagaatttaaatcatgaattctttacttctggaatttaaaacttatgaattgtttaattctggaattttaaacttctgaattgtttatgtccatttaatgttatgagactgaaaccatgggtaactgaaacagcagaaagcaaaccacagataaggggggactcctgtcccacactgtcttgagtactgtagcttcaaaagtaagtcttcaaatcaagttgtgtaagccctcaattttgttctgcattttcaaaaccactttttgacatttgtaggctcttcatattgctgttcgaattatagaattagtttgtcagtttctttttttttttaagtctgatgtgattacaatttgcattgtcttgaatctggaacacctggtgaaaactattttcataataatacttagacattatttgctttcacactcattgtctcaggagtacagtggagttttccagagaatacataatgtgtgatcttgcagcagattgaatgcagaagcagataggcaatcaggctctcttcttttatggtaaacattaatggtatttgcaaaagtgtaaaacaatgcaaagcttaatacattttattttaggaaaaagaaaaattattttaacatttaatgggcttgttaattttaaatgaattaatattttaacattttttaattttaaattccttctctggtaaattttgatagctataaactacataaatattaaaagttttttgggatcctcagttgtttttgagagtttcaaggagtcctgagaatgaagggtttgaaaactgctgccatagctcaattttgggacaattgatgccttaacaatatttattttttcaatccatgaatatggtatatctctacatttatatatgttttatagttttcagtatagagatttctgaagatgttttgttaaatatatttctaagtattgtatattcttttttttttttctttttgagatggagtctcgctctgtcgctcaggctagagtgcaatggcatgaccttggctcactgcaacctctgcctcccaggttcaagtgactctcctgcctcagcctcctgagtagctgagactacaggcacccgccaccatgcctggctaatttttgtaattttagttgagacggggtttcaccatgttgggccaggctggtctcaaactcctgacctcatgatttacccgccttggcctcccaaagtgctaggattacaggcgtgagccactgcacccagcctctaagtattgtatattgtttacacttacataaatgtaatataactttaaattgagttttctgctaatatatagaaatacatttaatttatatttagtgaccttgcagcctccaaaatttcaaaattcacacattagtctggtaacctcaaactcatattgtcaagaactgtgaaaggtttgagattttatcttgcttgcaggctaaaaagttagcctcccacagtttcatggatgctgacagaagacaggagaatcctgggtaagagataaagaactttattactcatggcatagcaggcagcatgagcttcatgttcagattgggtctccacactccctaagcttcatggggtaatgcagagtagcccaggtcgatgttactcgtgtagtaggtttgtgtcgcagttgaggaaccctgagcttaggaaataccattctttaaaaggggctgctagccaactttgcctaatctttgtgccagatggagatgttattttcatttccctggatagcaaacaaatctttcctttgccacagaaggagatactatctgttttccaagactgtgtactatataaacattcttgaaaagacaggccagaagaaaagctgataaagatatgcagaaacacagaaggcacatgggtaattttttcccaacttgtattgttgggattttcttcttagtcatgtcatgtcaaatacagttagtattgtgtctttccagtatttatgcttctccccttttgctatattttactagccaggactgctagtgtaatgtagaacaggagtggtgacagtggtcatctttgccttttgttctaggttttagggtgaaagtatgttattttaccaatcagtataatacattaacaaaataatcattgtagaaacggggtctaaaatgaggaaattatcttatattactcatttgctgagtgtttccttttatcatgaaggcttgttgtatttgccagatgcattttctgtatgtagtgtgatcatcaataaaaatacgattattttttattcctttattctgtcagtatggttagttaaatcaattaagttttaaatgttaaaccaaccttgcattactaggataaattccacttgaggtgaggcatggtggttatacctgtaatcccagctttggaaggctgaggcaggaagatcacttgaggccattagtttgagaccatcctgggtaacacaatgagactccatctctacaaaaaataaaaatattagctgggtgtggtggtgcacgcctgtagcccaagctactcaggaggcagatgtcggaggattacttgagctcaggagtttgaggttacagtgatgatcatgtcactgctctacatcctgggtgacagagtaagaccttgtcaccctgtttctctacaggaaaaaaaaaaatcccactttgtcagggtgtattagcctttttctatattatgaattcgatttgtggaccctttttaaagaatttttccatatatgttgatgaggaatattggtctgtgagggtttggtatcatggttatgatggcctccaaaaacaggttgggaggtgtttcttcttcctgtatactttgaagagtttttataagatgggttttctatctttcttaaatatttgttagaattaactggtgaacatatggtcttggtcttttatttatgagaaagtttttgaaaaaattcacttcgctagatataggattatttatattttcactttcactctgtgtcgttctttttatcggtctgacagatgaaaataacctgttttaaataacagtgaggttaaatagtagtagtttatggctgtttgcatttttttcctcctattttccggccagttttctattagatcatgtatctttttcttgttgaactctttatataatactatgaactttctgatatctgtctatataccaacctataatcaatattttccctatttttcttttattctgtttatatgtatttgctatgcagaagattttaaattttatgtagtcttatctgttaattttttctatatggtttttggccctaacatcatacaattgtattgaatcacagccatactcacttgtttatatgttgtctatagctgctttcttcctgtaatggcagagttgagttgtgacggagactgcatgtagctctgtgatcacttttcactgctgcttggcaccccaaaaatcatagttaccacatttaattattttaaacttagaaattgtcagtgtttttagtggcatgtgtattaacttacagtgacttttttttattttttatcagtgtaaatccttgatgtcagaagagtagaaaagtagactctgaatgtcatactttaaaaggcatagtggagtatggattattttgttattaaattagatggcaaagcattgtgtttattatgtaatgagactgtaactgtgctaaaagaatatacggtatgctgacattaccagactaatcacttatcacaatattttcaactcacagaaatgctgtggtgaaaagttagaaaatttaaaatcaaatgtttcattatagcagaatttctttacacaaaaaagaacattcagctgcaaacaaggtaaatttgcaagtgactcctttgttatccaagccaggaaagccatttattgatggtgagttaattaaatcatgcttgattgcagcagctgaagaaatgtgttcagagaaaacaaaattgtttaagactcttctaagccttgagcactttgggaggctgagatgagaggattgcctgagtccaggagttcgagaccagcctgggcaaactagacagaacccatttctacaaaaaataaaacaatttaaaaaaagccaggcatggtggcatgcctgtagtcccagctactctagaggctgaggcaggaggattccttgagcccaggaggtccaggctgcagtgagctgtgatcatgccactgccctccaccctgggctacagaacgagaccctgtctgagggctaagatttatttttttctgaacaggataaattgactttagctactattgaagactgagtggctttggaaattagctttagctgcagagttgataatgaattcaacataaaactataaggcaaaacagtgcttatatgtgaaacttaatattgaagtaaagtcacttagatgccacctaacattgttttaatcactagtaatattaagatgctttatacacttcttatgctgtcaaaagtgaaaataagaaatgagatctctgtttgcataccagttgtagcagatacattttcttagctcaactaagtactgttgaccttccatatccatgagttctgcatctgtttttaaccagctttgaatcaaacatatctgggagaaacaaatggcatctgtactgaacattcacagacactttttgatcattattctctaaacaatacagtataacaactatttacatagcatttacattgtattaggtattatgagtaatctagagattatttaaaatatacaagaggatatgcatagattagaagcaaatactatgacattttatattagggactggaatatccacagtttttggaatctgagggaggtcctggaactaatctcccatggataccaggggacagctgtaccagcagtgcttttggaccacaatgcaagtagaaaggaaatttctataattcaaaatctatttaactgtgcagttgaagagcttccacttaactttaattgcaagtgaagaatctgaaatgtagcaacataccaaaaggaggatatcaacagaagaatataataaaaatttttaaatgccatccaagtaatgaatatgcttaaataaaatcatatgctcctggataacagtattttttccatacacaaataggtgtgtgaaaagacattttcagagatgaaatatgtaaaatctcattagagattagcattagcagagtaacatttgcgattctttttttgtggggtggggggagggtgtaaacatatgtttttatttctcttgaataaatgcccaggagtgcagttactaagtcatgtagtagttgcatgtttagtttttttttttaaacaataaacattatttttcgataatttttagattcacagccaaaatgaagggaaatagatatatagtccatatactccctgcccccaaatgtgcacagcttcttccattatctattaccactcccacaccagaggggtaatttgttataaatgatgaacctgcattgactcatcatcatcgtccagagtccatagtttatattgctgactcttgatgttgtacattctgtgggtttggaaaaatgaataatggcatgtatctgccattacagcatcctacagagtattttcactgctctaaaaatcctctatgctccacctattcattcttccttctcccctaatccttggcaaccactgatctttttattattttgataatatttgcagttgattttgatgataaggaatactaactttgagtcccaattaagcaaattgtcctccctctaccaaaagaatatcattcttcacattaggaggcttatatacaaataattatactttgttattaatattatgttttgaattttgtcaatgaaaaatgtgtgtgaaattgttttctctcattaagtaccctctatgataccctcaatattgccttttggcccacaactaaaatatatactatatgggtctttatggaaaaagtttgctaacccctgattcatatcaatgtttaactattctaaccatttagatcagagaatgaatgtttttgtgcctcaataaatgtcagtttcaaaaaccaacagcagtaaaggaaattttgtttggggctcaggatattttgctccggaagttaagcttacttaaagtttactcttgttctgaaattgtgttaagttgtctgggagagggttgagcacaatacatgactgttgattcctctctgtgtacttgttaggtatccctggtaccctgagatgatggccccactcaaagccagacttccgagagcctggactggggagaaagatgcccctggctctgtgcactgatgcctccctccccgccccactccattcatacccacaccctctccctctagtctgcacctcttcctcctgtgcatgggaatatctagtccctcagttcccaaatttctgcagatgaagcacccattcttgtcattcccacttatgatccattttgatctagaaggtagtgttgtctcctaggagggcaacaagcaagtctgagctgcctgccccagagtttttgctgtttgctaaggcatctctggggtgaacagagggcaggtcaatgttacctgctgaccttgaaacccttggtgtgtgtgcagcacagcctggaagttgtcagtcaagattattctcaagcctcatagactcaggttcctagtacagacatctgcatccagaccagttatctgctcacaaaacaaagttgaagagaacaagaatgaacatcatgcagttttgatttttgcctcttcattctccctttcccccattttcatccacaaatgcttactgtcttcaccattttgtgcaatattaatttctctgggttatttatagggagtgggtgggcacagtgcttatgacttagaatggaagacggtattccccgaagagctctcaacagctcacagtctgagggagaccctgtgggtacttggtctgttgatcctgttgaaaagtgagcatagcatgtgggaaagtgactcatggatgtgacttcaccattgccctccttttaaacttcttacagtgaaagcataacccagttctgacaaaggttttcagccagggctgggcctgcctttgactcagcgatgtgtcacattctctctgccggaaactctcattcttaacaccagtcatcatggtcctggcaacacactttttggagaggtgttggtatttggtggatttattttcttttccagctgcccacaaaaaaacaaactcagaaatatctatttgtttttcctttgaaaagtttgttggaatagtgtgtcatttctccatctggagccgttgttgctttgccaaggatagtttgcttagggccatggcaaggtgacggtggccctaagtgaagggtaaaataactggggcggcatgcccgtctgggatggcgaaacctctgagctgctgtcaggcggtgggtggctagccatggctggtggccacaggccatcacttcaactgtggctgggatttgcttaaagaagtcctttaagtttcttaagtaatgtctgcccagtcactcacctaagcggatacctctttactgttcggtgattttgtgccaagagaatgcctagacttgccagcccacattggaaacttcccagaagcccaagggccacacctaatttacaagaactggaacccctattccattctttgctgcttacagcttatgggagaggcatgttctaacgggcttctttccttctaatttgtagatcctgtgcaggcagctccttgaaggcagggctgtgcctttcttgtatgttttcttagagtgttgagctcagaggagaccccagtagagaaggcactgtggcgtgggggagtaacacctgtttagtagtcaggggaatagggtcaaaactccacgttggccacgggctatgagatcttggcccagtcagttcatttctctgggcatttcctcatcatccaattgctgggctgagtgattctctaaagcagtggttctcacccttgctagatgtatgagaaacacctgtggactttttattctttaatcatacatgatctggccacagccactcatagtgggttcagcaagtctgggtggagcttgcagagtaaagatttttccagagttctttatggccagggttgagggccactatgtgcagtccctgactagataagcaatgggaacaaagagtgagtcgttcaggccacttccaagcttactcacgtggctttgggtaggtcttggttcctcatggcttttggcggaaggcctcattcatacctcactacctgggcctctccataggacagctagcttgccttcctcacagtgaatgagaatgtggacaaagtagaagctacagtctttttgtaaacgcaatctcagaagtgatgtcccatcatgtttgtcatattttattcattagaaatgagtcccttgatctgccttatactctaggggagaggattctgcaagaatctggactaccaggcagtgggatcattgggtgccatcttagaggctgccttgcacagcatctaggaggtggctgcagaatggattttggagcaggaacagggggaagggaagcagggaatcagaagggtgtggtccacaagctaatggaaggaggatagaattcaagtataggctaggttatgatgtcgtaacaagtcataatctgaggggcttgaaataacaaagatttatttcttcctcatgcagatagtagttacaggctgttttgggctttgtgccatatcatcacacgtgggacatgttcatcacgggtcgtctggggattcttctttatgtcattttcactgtgggacctaagctgacaaagcagcttgaatgtggaaaaactccaactgtgcttcccccactatactctcacaaagcaaatctgacaccggatgtgtggggatttctgcccaccagcaagcaagcagtcagttctgcagtgcacaccaactgaatgtcctttaattgaattctgacactgtctacctggagacagcatcggatcccacaggttcagggctcagtcccacgagactgcccccgtttcagataccagttgcaagtctgagcctctggaacttctgaccaaccagtgtcaagttggggttcccatgatctgctgtttgggtttgactaatttgctagagcggctcacagaactcatggaaacacaggtttaccagtttattataaaggatattgcaaaggatacagacgaagaggtgcttagggagaggtttaggggaaggggcgcagatcttccatgtcctcccgggatgcaccaccctccaggcacctccacatgttcagctatctgaagctctctgaacccagtcctcttcggccttttatggagacttcattggataggcatgattgaagcatggagtggggaaacctaccaaggcctgtccagattctcagcctctctgtgcagcattccttcctccagggtctggggcagcacccctgaaacaggggccttaggacctgcaatcagacaaggaaggtcctcgcatttgttcacggtcagtttcaggacagaaaggcagggggatatctgagtatgtttttagtttctaaggccttccttggggagaaaaaagtgcaggtgaaaggaaggcagaaggtcagtgagagagagatttgttttttgaggactaaaagtgccccaacatgaggtgataaggactatgggagttacgagccagaaaccatggttgaaaaccggtatattaatatatatgtcatagtatcacgcaagtactctcagaaacattgctggttgccatggcagagggaaaaagttatggaaaagcatgtattagctcttaaaacttcagcctatgttatttccattcacgtttcattggccaaattatgtcttatggtctaccaccacttcagagggggcgaggatatgtactcctgtcatgtgtcccgagagtagaagtctggagatatttgattagcaccaatgacacccctggggggagtagtcagtagtgttgccctccacagagccgggcaacgtgaccactgaacatggtgtttcggttggcattcacgtggtcattgttaatcttaatcttggccagttcagtagttgtagaaaaatgatgtataacctgattgcatggtttgaggagtgaataggagatgagaaggtgcagagagctagaaggaaagaattgtagacattttttaccatgaaggaagtttgaattaccagcctttcctcattcttttgtatgtaatcacagaatgatgtcacagtgttttttttgtttttgtttttttattttaccatgtacatatcaacagatttttctttgactataaaggactctgtgctttgataataatccagaaatgaccagaggaagtttatcttgtgtgcactttcaatattgtatttaaataggaaatcacccctttttacagttttcatctcgagccaaacaaagtcaaggtattatgagaactgcaacgctttttgaagaaacctatcatacatttatttttcttagtttttctttcttcttccctttttaactggttttgaagtttggaaataattaaattttattcagtctccaaagttgctctgaaacatcagtttttcttctttctttcttttttttttggacagaatcttgctctgttgcctatcctggagggcagtgacacaatctcagctaactgtaacctccgcctcccaggttcaagcaattcttgtgcctcagcttcctgagtagctgggattacaggtgcctgtcaccatgcccggctaatttttgtatttttagtagagacagggtttcaccatgttggccaggctggtctcaaactcctgacctcaggtaacccacccgcctcggcctcccgaagtgctgggattgcaggtgtgagccactgtgagtttcccatttttgctgagttcagtattcaagcaggagatgtgaaactacttggcaaattgtaaggtgatatacaggtataagtcattttgccactttttccattagttttggttggccaagtagtagcattctgcacattttatttctgttgtgagctaatggtctgaagttgaagtgcagatcgtccgaaactgtataattgagatgttgattatatttggcttcacagaattctaaaaagtagatttaacgtatatgttgtcctgaactaaatataagctggcacttcattaacatttaagaattgatagaaaagagacgtagctgcaaaccggggctgatctgcccaaatgcagcagcaatgattattttgccaccattttcttctcatcagtctcccatctcttgtcatggcctttttcacttcttcctctagcagtttcaactgactcagttactttctctaggccctgtactagggtagagatactgaaagagctggtgatacctgccttaagaagggtcaaaaaaaggccgggcatggtggctcatgcctgtaaccccagcactttgggaggccaaggtgggtggatcacttgaggtcaagagttcgagaccagcctcgccaacgaaaaccctgtctctactaaaaatacaaaaattagggctgggcacagtggctcacgcctgtaattccagcactttgggaaggccgaggcaggcaaatcatgaggtcaggagatcgagaccatcctggctaacacggtgaaaccccgtctctactaaaaatacaaaaaattagccaggcatggtggcagtcgcctgtagtccctgctagtcgggaggctgaggcaggagaatggcgtgaaccgaggaggtggaggttgcagtcagccgagatcgcaccactgcactccatcctgggcaacagagcgagactccatctcaaaaaaaaaaaaaaaaaaaaaaaaaaagcacgttagatgggcatgatggcacctgcctgtaatcccagctacttgggaggctgaggcaggagaatcatttgaatctgggaggcggaggttgcagtgagctgagatcacaccactgcactccagcctgggtgacaaagtgagactccgtctcaaaaaacaaaacaaaacaaaacaaaaaatggataaaaaaaaaagatgttgtggtggtaaaatttcagataacagatagatggggctggagagagccaactgctgagcatctctaaaacctttcttagacacctgtaattctagctcctcaggaggctaactttatacacaatgacttaagatgtcaaggaaaaattagctttgattcaaatattgtgtatgatcctcacattgcaggttttcggtgacctgtggataattgaaagttgatacatgatttaaaaatattttttggggggcaacattttctaaaaggtaaaccttaggtatacattttgatttattactaacttgacattccaatatttaaacttcaaattttgaaatacaataaagttactcctattgtaatttaaaatatcttgagatagctgcaaaaaccatctatttgttggtcctatcaaagaaattgatattattcagctatgagagttatgctggaattatgtttgtaaaaaattccttcccactttcttggcaagatgcaagaatgatgggctgtaaaattgaaccgttaaaatggccttatgcgtgtttgaaccaacatctgattttgaagttacccaactgcctgttaccaatttacctactttactgggtgttatgtttttgtcaatgggggttattaaatttaatactctaagtaagtgatataatccacactttttagcacacgatgctattctgataaaagtcacttccaggtacttgtaagtgaaatgctttagcaggcaaattcttctaagggtgtttcttttcctaatcaatataaatgtgcttctttatttttctaggcattaggtcctcttttcaggctatgagatatatgttgttcagctattatttgcatgcaagagtagacaccaaaagtttctgatttcttagtaataaattaaacctctttgagctgttgaagttattattgcccatgtgcaacagtaaaaaggaatattaaggtatgtttggagttgtatgtgacaaccaaaatgagtgattgaggtataagtctcaaatcattgaggtttattgagcaggatcgggagctcaccagggaaaaatgtgacttacggaagaatctgtgactggttttttccaaagaggttcataggaggtttagtatttatacattttccttaaaaaagaaggtagggtatggcaatggggcaattgattatgtacttgtgagactttagttagatctacattttatgtgagagaaagtgaccatttgaagaagaagagaagagaggaaggagaggtctcaaggagaggtgaaggaaggattaatctcatcttgtctttgttctgtacctgggaagacaagctagtagtcttttggaaatgctggtttctgtttagcccttagggaagaaaacctaatgactgttagcgagggagggggtatcatgaattatgtcctaatttcccatccttttttttttttgagatggagtttcactcttgtcacccaggctggagtgcagtggcgtgatctcagctcactgcaacctctgcctcccgggttcaagtgattctactacctcagcctcccaagtagctgggattacaggcccgcaccaccacgccgagctagtttttgtatttttagtagagacagggtttcaccatgttggccaggatggtctcaatctcttgacctcgtgatccacccgtctcggcctcccaaagtactgggattacaggcatgagccaccgcgcccagaccctaatgtctcatctttttatggctgtgacttcaacttccaagagttctgtggcattcctttggccaagagggcatctgttcagtgaggcgaggggcttagaattttatttttatttctcatatgtgttttgactgtaagtggttaggaaagatgaattttcgtctctcctcctctgccagttgagatatacttctagggctagagaggtgatattgctgttttatagggaagacaagtcgtgaattctaaaagaggacactgtcagatgtgatagtgtaagagggccacacggctatggagaatgttccatataagcttcacacactgacaacctgggcagtgctatgctaatcaatgggaaggttgttgtattgctgctttaaaattatttccttgagtccagctataactgggattccaaggaattactaagggggatacaaagctttctccatttactgatttgcttttggaaaagcgtataagtccgttcttgccctgctataaataaataccagagactgggtaatttacaaagaaaagatatttaattggctcagggttctgcaggctgtacaggaagcacggcagcatctgcttctggggaggcctcaggagcttttactcgtggcagaaggcaaagtcagagcaagcatcttcacatggccagagcaggaggaagagagaggggggtgaggtgtcacatacttttaaacaaccagatcttgtgaaaactctgtcacaagacagcaccaaggggatggtgataaatcatttatgaagagtccacccccatgatccaggcacccccgaaccggccccacctccaatattggggattataattcgacgtgagatttgggtggggacacagatccaaaccgtatcaaaacgcattgttgttttttacttttatttacaaaccaagcccaaaactctcaaacattatattgttaaagaaaaatcctgttgaaattgtaataacaaaaattgtgttcgcttttgaacaagattacttttgcaacatcttggtgggtgtaaacattgaggtttaggcaaacaaaaggtcggcagcttgggtatcagtccactgaaagcaggatccgaacaggaggggaagtggtgaagcgggtgaactcacccttgtagattttgaggttgagtggcttacagcatgttcattcaggaagagaggccagtatgcagttgcaattgcttgcagcctggaggaaggtcacatctagatgcataaattttggagacaatttatttgtcactgatgcctttggagacggttgagacccttcattaatcatgaaatgtgataactgctgttgtaacagcatgaacttggtgttaatcacagagccaatattattaagtgatgttaagtgttgggaacacaaccagtattttctcttaaggaaatgggaaggctgtgtctctgacctcacaaataaatattctggagggtggagttgacagaattttagtgaagcaggtatccagttagcacaggcccacagtgccaaccaactatgaattttgaagcagttagaccttacctaaaattagctgtgctgttaaaagagtgaataataatgctaataatgtgaccagaaccactgatattaaagccaagcttatcttgattacctgtgtttttactgtgtgagaggaataattgtgggaataattatcaggaaaaagtttggggaacagtaaacattgtttatatggacgattatgtttaattcaaataagaagcatacaataggagtatttataatccaggcagattttatagtcacagtttaaccacaggtaagcttgagttaattttaatgaaattctttaatgtatatttgtctttaaaagtagaaatttaagagtggcatatcactaagctggagtctatattacatagtcagctcaataaggtgattacctttgccctcctgtgttattgggatagaataatttttcttttcttctcttctcttctgttttcttttcttttcttttctttttttttttttttgagacagagtctcgctctgttgccaggctggagtgcagtggcacgatctcggctcactgcaagctccgcctccctgcttcaagcgattctcctacctcagcctcccgagtagctgggattacaggcgcacaccaccacgcccagctaatttttgtattgttagtagagacggggtttcaccatgttggccaatatggtaatatttctttttatcctgttaattttattttctttgtattgccattcatatattccgaccagtgttgtaatactgtttatttaacaatattaatgaaacactttgcatcaggcacaggagatccaaagatgaataaatgaaggtcttagtcctcaaggatgaaacattctaatggagaaaacaaatgaataaggcagaatcgcaggacaggacagtacgtgctgtgatggagagtatcacagtgaaatgggaacacacacatggggatggaagaagctttctggatgtttccagctgtattgcactaaaacaacaccagcagatgggatatagcaattcatttattcaaactgatcatagagcttaaagagctaggcaatttggagaattaatacagaattaatattaggaaatccaatgttaatagaaagggtgtgtgtgagattagtggtggttattcaggcatttccatttttaccatatgataagatctgaaccttctgaaacttgtagtaatagaaggacccatttttccttctgtgaaggacccatttttctaaataaccagttgcaccctgctttctgtggcactgcagacttctcccagttctggtcctgcaccctctaaaggtgacaaggctgtcctggactgatggagccacctggggccatcagcctcccacctcctttctggcttcttaggaaacctgtctgtttttcttctgtttacacacttgcaacacagttaagtttccaacagattgccttttcttttcatatgtacatacgttcttcttaatccatatgcttctttactccttttgacttgctattctttctttctctgtgttccaaatgtagactaaaaaactttaactatgactagcagcaatgaaaagaatgtaaatgatattactgtgttaagaaggcagagaccacttttttgttttgttttgttttgtttttttgagacagagtccccctctgtcacccaggctggagtgcagtggtatgatctcggctcactgcaacctctgcctcccgagttcaagtgattctgctgcctcagcctcttgagtagctgggcttacaggtgtgtgccaccatgcctggctaatttttctatgtttagttgagatgggggtttcaccatgttggccaggctggtctcaaactcctgacctcaagtgatctgcctgccttggcttcccaaagtgctgagattacgggcatgagccaccacgcccatcccagaccacatgttttaaactagaaccaatgtccccatttgtttaagcccttgaaaaggccctggagtcctgcttaaatcttctatgtctttatctgtttgtctgttgtctacttaagtctaatgttcttctttttataatatctgtgttcaagataaagagaatctaatatttctatttgtcaaatctttaaaaaagtatgcattcatattattgtatattatattgtattttatagatagcactgtctctgtgaaagactgttctatttcaaataactgacatagcaatctttgaaagcagtttttttctttactgatttgttcatgtatttaatttttcccatttattccctgaatagttactgaggcactgtgtactgggatctcagctgaaaaagttatactggatgcacttaaagattttgttctgggataaatcttgcacatacatacactttcttcatgtactttcaatacacacatcaatgtatagtatatatcatgcgtatatacacacacatatatgcatatatggtagaggagaaagagtattttccttacccattgcaaggttcgtggctgaggcatctataataaaagacaggttaataagagaaaagcgtatagatttatttaatataagtttcatttgacatgggagctttcagaagtgaagacccaaagaaacagggaaacctctatattttatgcttagattagatgaagagtgaacttttgtgtggaagtatgattggacaaagggggtatgatctaatagtaatatactggggggaacttagcaaagcccctttgttcagttcttcttggtgtctcagtgtctttgaggatcagaatgtttctttcctctgggtatagggaggatgcctctggaatgaagattttaggaccggcttcaggggagaagggccagggaaggtgagagtgaccttcctgcttctgctgtttttttaaatgtcaaggtgccatattttggggtagcctgtcctaaactccatcaatacctatacacagatatacatatacacacatgtgcccacatgtatggacacacacgagcatacacacatgcacacacacatatgtaaagtggtatttgatctaggaattgaaggatgggtcagagtaattgggtagaaatgtgagaagggcagtagttgtggagggaattccgtgctcaatccatcagggtaggaaatctcgggctctgtaatgttgaaaggacctggatttgttagcacgttggttctaaacaggggagtagtaagagagaaggctgaaaaggtagtgctgtggtttaaatgtttgtcttctcccaaactcatggtgctgatattgtttggctgtgtccccacccaaatctcaccttgaattgcagtccccatagtccccatatgtcgtgggagggacccggtgggaggtaattgaatcatgggggcggttaccctcatgcttttcttatgatactgagttctcacaccatctgatggttttataaagggcttttcccctctgtgctcggtacttctcttcctgctgccatgtgaagaaggatgtttttgcttccccttccgccaccacgattgttaagtttcctgaggcctccccagccatgcggaacttgagtcaattaaactttttttcttttataaattacccagtcttgggtatgtctgtattagcagcatgagaacagactaatacaattgccactgcagcagtcttaagaggtgggatctttaagaggtgattaggccgtgagggtttcgtcctcatgaatggattaatgacactattgcaggagtgggttcctcttagaagaataagctcagcccccttttctctccctcttgccctctctttgcttttctgccatgagattgttgcagcaaaaaggcccttaccacatgtcagccccttgatcttggacttctcagcctccagaactgtgagccagtcaatttctgctcattataaattacctagtctgtagtattgttatagcagcacaaacagactaggacaggtagcatagtggggatgaatttcagtccacaaagttaaccgtggctaaagtatgactcacttttttttttttttttttttttttttttttttttgagaaggagtctcgctctgttgcccaggccagagtgcaggtgcgatctcggctcactgcaagctccgcctgcctcagcctcctgagtagctgggactacaggtgtccaccagcacgcctggctaattgttttatatttttagtagagatggggtttcaccacgttagccaggatggtctcaatctcctgacctcgtgatccgcctgccacagcctcccaaagtgccgggattacaggcgtgaaccaccacgctcagcctactcactttttgatcataactccgtttatatttcaggctcatttctgaccatgctgtaggaggcatctctttattcttcttttgaggtcatctcctctctgccttgtgtcctggtcctgggatcttgcctttgccggtcactgggtgggcatctggtcctcactgggtgggcatctggtcctcactggtggctaatgcaaggtactcctgagacagaaaacctcccagttctccaggcccttgggctctttgctgtgtgggaagctttgtgaggctgctgcctgccaagctccaccacaaaccacccttcccttgttggggtcttgtcccttccccagcagctctgcttgtgaacccagaaacccatctcttctccgtcctgcttgctgcaggtctctttctagtctggtggaacttggtagttctggtagcaggttacttgctctacacatgagaaccatttcccatctgtgcttaggcttagtcaggatcatttgtaggctagttctgctgctttcaggtcatacccgtctctcaagatcaatgaacataaggacctgttcctatcttgattgaggaggaaagaaggggaatgtaccagaaagaaaaaaaaattagatcatttctcaaaaaatgtgtcctccacaggatggatctcagttgaggcgggtcttagacatcaaaattgaggagtccaggcttcactgggaaggtaacaggaagccttgagtgaccctgagctggggagtgacatgtgatgagggttgtgtttctcctgtgtggcaatgggaggcaaacaggagaggggggaatctggattcagggagaccccaggggaggctcctagcatggtccctgcaggggtgatttctggtgctgcagtaggtccttaacttagagaacaatggttagtacagctcgtgccctgtggacctcacccaaggctttagttcatggaactcccaacaggaagccatattaccaaactcttacttatatgttaccttaaggcagagctgttctcattgcagaatgttaccatttgaatgggaagctctagaggtcgagaaacgatcagtgactgaaaaaggaagttacagaaggttattcacgaagggaacattctttcatttcatgaccacctgacgcactgtcaaattgaggaagccagcattcctaatgggttttttgacctggaaggacattggatactctgaaagaggaagctactctaataaggttggggcccccagactggtaataactggttaacttggggagaccttgccgagtgttaattaaatttgcattacaggtggaggaatctgatgtctggaaatactttcccattccatttaaagggtaagctgcagatctctaaggctctctttgtgacttttaagaaaatagcagacaaagaaggcttttgtgggataaaaaaaacacggaaagtttcttgctgaaacttgatgagtctgcatttgcagcacatacatgtatcagatttttttgtgtgtgcccagataggcatttttgcttttaaattttcagctgagtctgattacctaattagttcagattggccctttcttggggagacagggaggaaagaggctttgaagttgtgaaagggaccatgaagcagacagggttctgggggttgggaaggtgctgctggtgggaggcgtcctggaggcttctgtctttatcctcattgcgtctgtagcagttcatgcagaggaactcttagggatcccgggtgatagcagtcactgggctttagggaactctgttggagagcctgcaggcaagtggatcaaaaaatcaaactgttgagaggggtgtaacatacaaagcaaggttacatcccttacagtccgtctccttaccacatcccactctctggaaaccaccattgacaagagtttcctgtttattcttataaaaaactcctgtgcgcaaacaggcacacattgcttttaaacacacatgatttgtttgttctcattattcagattgtaccacctgacacccttgactctgctgttcccttttgccagtcagtccagctcggtccgtcccacagctgcggggtagagtccaccatgatccagtttgtttcaccaggtttctgtgagaaacagctggatgtttttggtttccagcctttgggggttgaatgataaccctcatcccccaaaaagatatgtccacatcttaatcctcgaacctgtgaatgagatcttattggaaaattaaggatctagagatgagatcatcctgatgtaaccatgtgggttctaaatccagtggcaagtgcccttagaagacacagaagagaagacacagggagaggagatcttgtgaggatagaggtagagattggagtaatgcagccacaagccgagaaatggctggagcccctagaagctggaagaggcaagggatgattctcttttagagctgccagagggagtgtggctctgctggtccctggatttcagacttctggtctccatacccgagagagaatacatttctgttgttttaagccacctagtttatggcaatttgttagagcagccctgggaagttaatacactgcccaaactctgatctaatgaacatttttcttattatgagaaataatggacaccttctctggacacatctgggcacatctgctcaagtttaccttcaggacaggtttccagaagtagaattttggttctaggtcctgaaatattttccccttcagatgtatttcatatcacatgcatccttgccttaggaataataatgcaagtaacagtagcaattactgtgtgttgagtgctttttgtgtgtcaagcattgtacctacattatcttattcatcctgacaataaccctatgacacatttattattatcctctttttatggatgcaacactgagatttagagtattgaagtcacttgcataagatcatatgcttacataagaggcaggggggccaggattcaacccaccctctaactccaaattctgtgttcttagctatgttgctgggttgggaagataaaccacattttagactttttggccctgtgttgtatggatgtggtttggcatgttctggccactgggtgtggtgggttctgggaggtgacagactcagttataattacaggaagaagtctggtctggcaggcagcatgtggaatcaatccatggtgcattgggagtctggtgaaatagcaccatgcagatggtccatcttggcgtaatgggatcccaacaggtggactgaacatccaggagttagaacatcagtgataatcacaaagctacagttattgttagctcttactacatgtcaggcattgctctaagtgctgtatgtgtattcacccactgtgaagtaggtaccgcattagcatggaagggaaccatcagtaagtcatgggacgcaactgcttggcattcaggtacagatcagctcctgagtgaggagacagcaagaacaaggctgaaaatggaggtaccaggtaagttcaagaaagagacctcagctcaggctaccgggtgggtacccagttaatagagttgcaagatgggaatacatctcaggagagaggcagaagtttagttaccggaacaggggtccttcatcagaggtcagcgtagcatgacttaacaccaattccagaatccatttggtgcctgctctaaggagtgtagcagcagcaggcccaggaggggaaataatggagcttgccattgacttcctcaggcttatgaccttgtggttatggcgacatacatgagacccgagactgcggtgaataagtccttgatactagtgtgtcgtgttctcatttatttctttattgcaactagtgaacacagggttcagctgtaagacttctgggcagcaccgcacggtaggctttctataagcttagtgatgtaatcctttaactatttttatctttaatacaattgttatctctactggctttgttggcaagttttaattcacaaggagcattaagaagcgtgatttctgttggctcagtaaagtgattttcacttccttgtctcgttgggccacctgccatctcttaacttttggcaaaggaaaataaactaacacattgtctttttatttatatatttatttattttttttggtggaagaatatccccatcttgtggatatttgcattgtgttttagcttccgtggttataaatacagattcacccagtgtgggcacttgatcacagagattattcttagagtcttctttggtgtccaatttcaccagcatttcggattctggacacagaagcaccaggctgtccctcctttatgcttttttttttttttttttttttttggagaaagggtctttctctgtcacctaggctggagtgcagtggcatgatcatggctcctgggctccagtgatcttcccacctcagcctcacgagtatctgggactacagttagtgcctggctactttaaaaaaatgttctgtagaggtgtgctctcactctgtctcccaggctaatcttgaactcctggcctcaaggaattcttctgcctccacctcccaaagtgttgggattacaggcatgagtcactgcacctagcctcacttatgttctatttacctttaccactgttgcactttcagcattttcaaagtcctctcaaaataatggtttcctttgcttctccaaacagacttaagtaataggttatacattctactttaagatgagagaattactttgttttaagatgggggaatttattgtgtaacagagaataaatcagtcttagacctgaggccagaaatctctgattttcttgacttcagatcacttaccactcccaccctctgtcctgcccccagcttcaatcatggaagaaacagaatgtaaatgatagctgtgtctcaaaccatctttcagaaagctgaccagaaatataagtcacattgtttataaagtgccgatggagtttatccaagcagaatttgctttcctttaattatttgttaagtgcatttctcgagttttcggaaatggaaatgagtttactttatgagccataccatcatgttctaattactattttaagaagttaaagacctccaaaaattggatttgacttaaacatacaatgtatggtgtcagagtaaagattagggcttggactgatgttgtctggtacacaggaaaaaattctattacgtatagttaaaatgaatttttaaaaatttggtgctgaaatagtaaacttcagtctttaggcattcactttggtaaaattcctggaaagcaccaggcatgtcaagtgctataatacaaagttttacaaatagggatttgaagtgattgcttttatggcatggaataatgccaaagaagtctcttgttaaatatggacagtgagccgggcgcggtggctcacgcctgtaatcccagcactttgggaggccaaggcgggtggatcacgaggttggaagttcgagaccagcttggccaacatggcgaaaccccatttctactaaagatacaaaaattagctaggcatggtggcgcgtgcctgtaatcccagctactctggaggctgaggcaggagaatcacttgaacccgggaggcggaggttgcggtgagccgagatcatgccactgcacttcagccttggcgacagggcgagactccatctcaaaaaaagaaaaaaaaaaggaccagtgtgttcttggagacagagtcttgaagtagaaaatgcttaggcacattcttgatttgcacatgctgacgcctgcatgtgttccgctctgtttggaaatgtatccctagactgtaagcttcatgagggtaaggtcttagtccatcttgtttttactggatcccttggcttagaacagtgtacagtagggacttaatatatatttgttgagtgaattaatgaacaggtacataaaggtagcaagaaatgaatgtagatctttattagtgacaaatgagtgaaactaaaattcaaaaattggggacttgtatgctatttgatcatggtcaagatgacaagaatatatcatttaaaatattatataatttaaaagtagttgtgcattgaaaatgcgtgacaggctgggtacaggggctcatgcttgtaatcccagcactttgggaggccgaggcgggcagatcacttgagatcaggagtttgagaccagcctggccaacatgttgaaaccctgtgtctactaaaaatacaaaaattagccaggtgtggtggcaggtgcctgtaatcccagctactcgggaggctgaggcaggagaatcgcttgaacccgggaggtaaaggttgcagtgagccaagatcgcaccactgcactccagcctgggtgatagagtaagactcagtctcaaaaaaaaaaaaaaaaagaaaaaaagaaaaagaaaagaagaaaagaaaatgtatgacaaagtgggaaaagcttggattttttcatagtggggacaaaatatgagattggagatgacatacctagcagagtccctggcacataaaagcagcatagaacatttattttccgttctcattagtgccttttagatcaaattgagaaggaaacactagagtcagcgatacttgagtagggtgatattgccctccacgtgacatgtggcaatgtctggagacatcattagttgtcatggcttgggggagggtcctactggcatctagtgggcagaggccaccaatgctgccaatgcatcctgcagtgcacaagatagccccctacaacagagaattacctggcactaagtgccaatagtgttgaggctgagaaaccctgtcctagtcactcataaagctatattaaaatattgagccagataaaaattgtgtcattatacacatctcatgttgaatcagatattactaactaaagtctattaatatgtagcacataagtgaattttcttatttctttatgctatggttcctgacgtaaattacttttgtttttaaaaactgatgatttctgtcaatatcagggacacttttcaccaatatgtttatatatttttaaaaagataacatttgcttttcaaacagtgcagtaaacgtataccaaatgaagcattgctgagctgagcaagccctattacttgataaagttacaacagccacacaagaatggaacaacttgtctatagtttgatcaaaatacacctgattaaaatacatttgatgagtttgctgatatttattgaaatgaaacctagttgatgttacgtgttttatatacatttaacccgcattttagacctactagacttttacatttaaaaagagtttctgttttctctggaagaatattattaatttctgcagcagaagagagttggaaaattagggtaattccactgtttcatttgctctgtctttcagacatggtgaaatgtttcatatttgagtaattggacggagtgggaaagactttgaagatattctttgtgtttattatcattggcttgaaagttggccctttttcctggacatttcatggcacatcagtaactcacttggtgggatcacaggtgttgcctttggtggactgatattctcataatggggatctgatgtatggtatgccgaatctgtcttcgcgcttgtgacattgctcttaactcttgagtgctatctcaagtgtagtttcttgtgaaaattgatgacatttactgaatgccgagtgtgtgttgggcacagtactaaatgctgttcgtgaattacccatttcattctcatcacaatgtcatgaggtagctactattatggttcccattttagagatagggaaacaggcttggaaagtttaagtgatttgtccgtggttgtgtaactagggggtagggaggctagaataggtcacgttaccctgttgatgatctttgctgtcttcaaaggaggggttgaggcggtggggtgcttttagtgagatagcatacagagagaattctgaccttaactctaaagtccaactataataaaatagcaatgaaatataactcaacgccatttcatatagctctgcaaggagagggaaggcacttgctggtacagttgggtttaaaaggattaccttgttgagtcagttttccctccccttggctagcagttggggcagaatgtggaaatacagatttgcagtaatgcatgacctgagaggatgctgcttgagtcaggcttggcttccatagtgtgcacagacttcttcatgccccatgctgctctaattgtacttaagaaccatctaggaatgctatgcctctgggtagcagcacttttgtggagcctccctgtccatgtccagaaagctgtatgaatggaggtttgcctggtacttaatgtgtgtctacgtgtgtgtatgtatgtgtgtgcatgcaatgtatgtttgcatgactctcattggtggtcgtggggagtgtgtcatctcctcccatggacacttcctatatttctggtagcctctggtcctgtggggctgtaagtagttaattgttcctagttctctctggtctatgagcagcttaagcatagatattgtgttaatactagtagtaacagagaccctttgagttctggtctctctctgttttaatgatgaagcaactaagccaaagatgggtaaatagtgcctgaggatactcagcccatgagtagaagagctgaggttcctacgtaaggcggtccaaggtcaacatctgtactctcttcactattctctgttctctcttttatctttgtatccttggcacatggtagttaatcagtaagtcttagctgaataaatgctgcttatgaacacttctaggtggaaattaagcattgcttttaccagagtataatgctgaattgtaatatactcaaggatggtggcaagaatcccctgtacttggtgccgaatcctctgactaatcgcccgaaggaagttctgtgttctcagagcatctgtcctatttgtgtctcttgggtctggatttcccagtctttagtccagtttcataatctgcctcctgagctcttccagggaaactttctgagcttttcttggtgctgtttggagttccactttcagagtgaattttcattctgatgttccctgattggggcctcccctgttgccctgggagggagtcctcacattacccccagctcaagagagagcactggccaggcgtggggcacctctagctgtgtgactgtggagagtagcctttttacatcttgagtttttcatctacaaattgtgagggaaattacctactacaaattgtagtagtaggtaatcttgttctatagttctttgccgttaaaaaaattatggacccctttaacaatctgccaaaaacacaccttgtgctgtgcgtgcacgtgcgcatgcacacacacacacacgcgcacacacacacacacacagtttgtcacagaattccaaggcacccagagaccctgctcactcagatcccgtccctttactagttatccatatgtaaaggatctgttctttattgagttctgtctgtctttgacagtctgtggcatgccatgataaagttctttttaaaataccaagtttattgaaaagatagtcttgtgttagaacttgtaaaactcacaaacctttcagcctgggctttgaagcaaaaaaggaaggtttagaattacaatatagactcccatcaaataggtgttgacaactccagacattaagccttctgggttattcctcactccctgccttctgatttttatcccattctctcatcatctgtattatatacaaacaatgggatgaatgttttttcttggaaggaataaatactggaaggatgtttcataggtggaatttttagtcttagagagaacatcagtaatttatcttcagttttagtttaaatggaaggagtatttgaggagctcctggatcccacagaagaacttgaaatcctctctccccattgctctcgaactctgcatacagcagctgcctccaaaaagtccccatttccatgaccctaaattctcaaattcttctgaccacctctcttccccaccctcccaacctacctggacctattttctgctagtatattttgttctttattatacaaatcccacctgccctcaaggaactgattcatagacctgcactccttccttttagggggaatgtttcagtcacttatagtttcataaattcctttcatttctgtcacaggtggaggggagggaacccagggagtaagagaccaccccacagagcatccactctattagaagaccatgtggcacccacacgaactccagcagacattttctgaagtggaacgtgtctttcaacaaactagcattttgttcataacattctaagcagtccctggtatatttgaatgaagcttttgtttcacttacatgtattttcaaggggaaataagtgagtaaaataaaatatttgatttacagcggttaagatggttaaatgcaaacgtctttggcttgcccctctttcccctccatattgttttcccctgctctccctcctattcagtgagatagcctgttgttcacggattctaatgggattttatttaccgcctggtggaaacagttgaaaaaaaattacacaattggaacaattcaagcattttgaaacattctcttggcagtttttttttcttttttttggcaactaggatacgcctgctcaaaacatttttaatgttttaccttcatgggctccgcatttgccagtgtaaatgtttccaaattgttctcttgatttcattcttaagaccctaggcaatgaatataacatatgtatatatgtacgcacatgtgtatatacatatatgagtgtatatataaagagaaattactcttgttctttggtttaaaaataacaatgatttcttgcaaagagaaatcataattgtgaagctacagttatcagaagccagctaattgaattccactgagaactattagagtcatatacagtaatgatgatgatgattatcatcatcatcatcatcatctcaaaacttgccttggcattcataagaaatctcatgatagcaatatattttagaaatgtggacataactagttctttttattttctttttaacatttcaacaaagtgggacttagaactcagcatctcctgggtcctacataagtaatttaatgtgaaacttaaagatgtaaaaagagagtttaacaggataaatgggttctggcaatacaaggtagtgggttagtaatgtaagttaatgatatataactttcaataaagcttttagagtttttcatatttgcagactatttacaatttttttattaatagttctgcaaaacaacttgtttggaataaatttattttgtatctcttcttcaatgacataagaaggttaaattagcccaatcatgcaaaacagtgagagagtcaaaatttaggggatttctgtttcagtttccttcttcccttaagatttttgtctctgatacttttttaaaaaaattttaaatttttgctgtatctaggagacctaatgtaagatattggaacaagcagttgtctctagacttgtttctgccattgttgacatttacttaattttttgatgttgcataagttatttaatttcttttgcaatcagtttcctcacctgtagaatgaggagactggactaggtgatttcctaagtcccttttagctgtctgaacactgcttttcatcggtgaagttacaactggcctccttcaagaatgtagagtactagaccattatcacatgagttacagataaggtctggggaattacataaagtcatttactgtaattggcttgcagtactctgtgagtaccacataataatgctattttattattcagtgtgttagaggttacagattccccagttgccagagatgtgatgaatccccttggccttggcaaacagactgctttcatgagttgcactgcacatggttataaacccaatggctttctgagctaatgtgcaaggtaatgccatcttccaaatgaaaaaaaagttgcatttacccattcctctaacgagaatatatttctcctcactttaaaaataactccattaccaaatgcaaatatgcataatgagatggaattatttccaaatttatacactatatagtttttctagtgtaagtaaactgttgctatgaaaccaaaaactaagaactttactgccccttttgtagtctaattacttaaaaatgaacaaagaatggttttattctgtgctttttttaaagcaagaaaatatatatcagtatataacaatagtgatcttgaataaaggaaatgtgtttttaagatatagatggggcaaatttttcttatcagactaatggcactacagatgacaattacaaactctgaacaaaatataaagtgaactatttgaaggcatttgagagcaataaaaagcagactgaaattggagggaagttaactaaagaaagaagggacccccaaacatctatatataaactcttcccaaatttcttggctgatcctggggagactccaaagttcctagtgaaaagcaacagctggaaagctgaaagaactgagctattgcacactatagaggaaagataatttggagtttgaatctagccaagtaactgcctgggcaacaaaataattaacattatttagagtaagatagagagtctccgcaaaataatattcatgaaatactgtacctaataataaccatgagaagaagaggaaatttgactcatagagaagagataaaacaatcagtagaaaacagctctaagatgactgaagatgttggaattagtgcacaagacttaaaaagcatatatatataaatatgcccaaggacttaaaatatgatcttaatgaaacaaaagatgggggaatttttaatagaaaaatagaaaacattaaaaaacaggtggaagtttgaaagggtaagtggccttgaagatagatcaatattaattatttaatctagaaaacaaagagaaaaattattaaagaaaaatgaataaaatctcagtgctgttggagtaatgtcatgtaatttaacatatatgtaattgtagtctcagaaggtaagaagagagcaaatgtaacaagaaaaatgtttaaagagatagtattagacagtcttgcagattaggtgaaaaacataaatttagagatcaaagaagctcagtaaaccccaggcaagattaataaaaaggaaaccacacctgggcactgcataataaaacaactgaaaaccaaagataaaggaaaatcttgagagcagccagagtcataagacatattacatagattggaacaatagtacaaatgatcacttctcatcaggtacaaagtaggtcataaaatggtggaatgacatttttaaagtgctagaaaataaactatctatactcagaattctgtatccaaagaaaaatcctccaaaaatgaaggtgaaataagatattttcataaaaatgaaaatggagacaatttgttgtagtacatctctacagcaagaatttctgaaggaatttctttaggcttaaggagaaggacactggatgggaactcaatataatagagtggtgtggggtttattacaaacatagatgtaatatatgtaaaaatgtaagatttttgcaacaaatgctattgggatctcaagaattgtgagttctgccaacctattatcctgacaagaacgacaacaggatcattggtggcaattttaatggtgctttgtagttttcagagtttttaaagtgtatgttggtttattcttagagtcattctcacaggattatttgggagaggaatttagcagatgatgttgtgaaaatccacttgtaagagaatggaaaggaattggtggtgatgggtgtaggtagatcacatatgagagtgacagaaagtagctgagcacaggaaagtgcatgattttagttctagctactcagaaggctgaggcaggaggataacttgaggccaggagttcaaggccagcctaggcaacgtagtgagaccctcatctctttaaaacaaatcaaaactaaaaaaagagaaagtgatagcaggtggtggtggtggttttctatctgagaagtcctgctctgataacttggtgactcttatagggtagaaggagtggggatggaagggagaggaagatactgataaacccaatcctagtagaaacaatggctctagtaattttttctatagaatcatatatgcctacaggttctatagaatcatatttgcctatagattctgtaatcaaaactttcttgaaggagtcttgatgttaaaaattattctgctttaatgtatccaccgtggtctctaaacttttaaattgtgtatgtttatcagctaaaatgtttcaatattaccctatatatgcatcttttaaggcaacatattaataatataaagcatcctaaaaatagttcaagtggatgaaataacataactacagataaaataaaagtcaatatgtaaagttctagtatttttctcttgtatcccagcattgtattttgtactgtttgggtatggtgcctagtttgaagacccctgcagtgacaatcaagcgggatcattggagttattttgtttctgatcatctgtttatgcatttatgtatgaaatacacatatcattttacgccactggaataccatgtttttaaaaaaatcatagacattgttaaaattcaactttattttgttttttagcttttcccactttataatggtaccactctccttcacaaataagtagtattaataatgtggtggataacctgtgtttttcttctgtctatataattatctttaacttttttagtgcttaataaacaataaggatatagtatgttaatgtttctacaccttgattttctcacttaaaatacagcatagaagttcctccctagcattgacaggattcatttttagtggttatatagcactccattttgtaaatgtgctgatttattgaatgaatcttctgttaatgaatatttagtttctggtagtttttctttttgctgttataaacagtcatttaataaccatgttaaatatatatccttacatactagactattatttcttaaagaatgtgattagtaggtcaatgagtacatcagtttttgatttaactttttacagattggtttccaaagtctgttacaattcttgtttctattagggattccagagtatacttctcccccgactttatatccccatgacaatagttcttttaagaaaaattatttgctaattaattagcaaggtgagtgcaaatgtaatctcattatgattgccttttcctcagtactggtgcgggtgggcattgtttcatatatcacagtcatttagatttatttagtgaattgcttattcatgtcctttgtccattttcctattgggctttgttttatttgcattgaatcaccaatttgtcttgttatcactttgtgggaaacttctgtatcttatgccctaatttttcatgtgcattgcagatatttttcaaatgtattatttaactattaactttatggtgtctttttatatataaatgatttttttctgagacagagtctcactctgttgcccaggctaagtgcagtggtgcgatctcggctcactgcaacttctgcctcctgagttctagtgattcccctgcctcagcctcctgagcagcttggactacaggcgcatgccaccacacccagtgaattttgtattttttttttttaagtagagacggtgtttcacctgttggccaggctggtctcgaactcctgacctcaggtaatccgcccaccttggccttccaaagtgctgagattacaggtgtgagccaccgcgcctggcccacaaatgatttttactttataaagtcaatatattttttccgaaagtcaaacttgcattatttgcttagaaattccaatgcaaagtagggcaactagcctcagagcaaggctctcctggtatatatgggaactgtagaggcactaccttcaccatgttctctgaacagacctaccaagttgaggcttaaattgggtacatacccaactgaagtttggctatgagtcctgttgttctagtataagaagatttacttgttcagattttgcagcttctcatataattttgtacttgtgctccagacatattgaaataagccatatatttttttctccagatatattggctttaggggaaaaaaaccctccaacattttcagcagtgttagaggatcttgcaggtcctgtagggcagtagatattttgtttcagctggatcaagccctaaaaggggattggaacagatgtttgaatttggttaaatgctttcaatatttattacttaggtgacctagtttagcagcaattgtaatagaaaaaaaacaaggccatttgagaaaaacagagtttcttgcattcaccttaaaaattgaaagaattttccctttttatttagtttattttatttagcttgaatgtgggaaaataaaaccctgagagattctcttcctaatttgaacagatatctacttgtatattacatttaaaaaattttcccgtatgaaatatttttttggtgtgactggagaacagttttggagctacagttcttgatgtgctagttgaactctgaaagctggaggactatagagatatctcatagagtcctgtacttcataaatgaagagactgagacttagaggaatttggtaacatttgagttagggctctcagagattcagcggcacgggcagatggatgatttgagtttcccagatcctgtgtagtactgtttattcttcccctgtgttgagcaccatgtgccacgtggatgcctgtcctggagaagtaggtgcttgggtcctcctacccattggatttatccttgactctgtgggtgcctctcatagtgctttagtgtcaggaaggtgctggctagtaagagggaaaattgtgaacgaacagcttctctgacatcttcccactaccttttccattcttctaggcttaaaggtcacaagggggaatagataaaattagcatccgaaaccaaaatccatgactgtctcttgcttccattagggtgcgaggtggagagttcaataaaacaatcatgtaaatcaaccactacagcaatgcagtgggagaataatctggggagtgagcaaaattaggcaggagagttctcccaggtaagtggataaaggttatgtctgacatctggcaaactggatgttaattcctcacaatgcgataagaggagcatcactggagagcataacgtgttccggctacagagactgacagctcatgctgtggttcatgggaacagctaagtgaagagtgcgagagtgcaggaggagtaaaaatgaagttgataacatgtgggatagaagtatatacctagctgctactccagaattggcatctcaaatggttacctaaaaggggataaagacatatttgaaattggctgagatgaacaagacttgacactgtgtcatccagaaatatgaaggatgggggcagggggggcaagaaacccagcttctttttccctcattcactgtggtacctgactttttttttttcaaggaatctagggtataattgccttttttatgtagttttaaaaaatttttgtaaagtatatgtaatgtaaaacttgccatcttaaccattttcattgtacagttcatggaagtacatgcaccgtgctgtgcaaccatcactactttctgtttccagaacttttcatcaccccaaggagaaactctacctattaaacagtaattctctctctctctcccccaacccctggtgataacctctactctattttctgtctataaatctgcctatttcagagacctcatagaagtggaatcaaatcatacagcatttgtccttttatgtctgtcttatttcacttagcatgatgttttcaaggttcatctgtgttgtagcctgtgttagagtttcatttctttttaggattagataatattccattgcatggacaaaccacattttgtttgttctttgtcccaggacatttgggttgtaggttctgcctttttgctgttatgaataatgctgcagtgaacagtggaacataagtatgtttgagaccctgctttcagtgcttaggagaagaattgccaaattatatggtaattctgtgcttaatagctttttgaagagctgcaaaactgatttttcacagtgcttgtagggctaggttccttgactcttacaaactcattaggtattaaggagtgtgaacagctgaccctaggattgctgaatggggctttgcaaattctgagctcattgtttacaaataacttcaaaaaaaattttaagtgaagcttatatttaatgaaactttagaaagtaagctttgcttttttcttaagtatacacttaggcagtctttgaatagaaatctaatattatcagagggatgaaattctgtttttgttttgtcgttattggaagaggagtgaaagaattgaatatcaggtattgtgctagatattttcacccatcataaaaagaaatcactcatccttatcgtttctgcattaactttgtgaggcgatgttattacccttatatcactatgaaggagttgaggtaattcttcccttccttcccatgataagtggtagagctcaggtttggttcttagaattcagttaaaaagtctcgtgattggcatttccccaataggctaggagccttaattactcaactgtttacattttgaatttttttttggattgtattagttaggttttctctggcccttgttagtttagataaataggagatggctacaatttctttttaatttggttttagataagctctcctcagtaaccaaatgtagtagctcgttttttgagaaactcaggagtttagttattaacaatatctctttcaatggttgcttgttaaataacttactcagttcaaggttttgatgatttcggtgtactgtgcttttcagaatttttgaacacagttacctcatcctttgcagataggatatctgctttttttagcacgtagctttgacaattaaacatagaagagaagaggatatgtcttgtgtccaggcaacttgagtatagggccacctctctggcctaatggggcatccagaggacacatttggaggttgtgcagttttgatctcctccttctccagggtcgaaatttctgtgtgcctggcctcatcatctctgtaaacctgtctgtcattggctcttcattcatatctgttgtaatagtttggtgatagtagcccacgtttagagcgctagttttcaaccatggaactattgatatattgggccaggtactttttctgttggggtggggggctgttctgtgcattataggatacttagtgtcatccctggctttttcccagtagatgccaggctgccatctccaagtcttgacacttaaaaatgtctccagacattgccaagtgtccctgagaagcaaatacagcccctggttaagaaccactggtaaaggaagatttggaattacttggttgtgttgatcatgtttcttaatgaccattactaaaaatcgcttattttctatattttttccctcaaatatctaccttctttcattttaatttctcaatcccttttgtctctttcatctcatttagtcgaagacaatttttattggtctttctcttatattttcatttctcccattttcctgactttgtgtttgctcctttcattttacttttgctgtgtttttctggcatactctggttttcccatattctttactggcagtctgtatatgctgtttgtatgcactgtccgtatgcacagtctgtatgctgaatgcacagtctatatgttgtatgcactgtctgtaagctgtacgcattgtctgtatgcagtctgtatgctgtatgcactgtctgtatgcacaatctgtaatgctctgtatgcactgtctgtatgctgtatgcactgtgtatgcacagtctgtatgctgtattcattgtcggcatagtctgtatgctgtatgcactgtctgtatgcacagtctctatgttgtatacacagtctgtatgctgtatgcattgtctgtatgcatagtctgtatgttgtatgcactgtctgtatgcataatctgtatgctgtatgcactgtttgtatgcagattctctatgctgtgtgcactgtctgtatgcacaatctctatgttgtatacacagtctgtatgcatagtctgtatgctgtatgcactgtctgtatgcagtctctatgttgtatatatagtctgctgtatgcgctgtctgtatgcagtctctatgttgtatacagtctgtatgctgtatgcactgtatgcacagtctctatgttgtatacacagtctttatgccgtatgcattgtctgtatgcatagcctgtatgccgtatacattgtctgtacgcatagtctgtatgctgtatgcattgtctgtatgcatagtttgtatgctgtatgcaccatgtgtgtagtctgtatgctgtttgcattgtctgcatgtgcttccctttagtctcttcatcagcagcctgttacctcctaattctgttttggtctgataggtaattccatatggatggggtcatggaccataaatccttgtctccgtttacgtgtgtgtgtgtgtgtgtgtgtgtgtgtgtgtgtgtgtgtgagtgttatgctgccatgtggcatcttcctaatggtttgcttattctttgccattccctatgtgcatattgcccttgagcactctccagggggaagagattttctgcatcaaatcatagctgacactttaatttacttgaatgcccatcctgcttgttgagtagcattcacccatccttctcaacaacttgaaggcaggcagggtgcaattgatcacttgaattttgtggagaagaactggccctggcagcctgaaggtgacccctgcactttcctcctgaatccctgtttcctcttctgctttttcttactcctgattataaaactaaggaccctcaacacaggggaacgggttagattgtgttggactggacttctgtgggaaactttttgtggcctattgggggttcctttctgtgaggtccaaagcccttttcttaactggaaagggccttgtgttctgccagatcctcccaccctctctgcaggtcaaataatggatttagtagaaatatggaaaagtttagtctgtctgtgcgccaaaaattgccactaggaaggcagcagtgtaaacagtgtgtgactaattctttcttttaaggaaagcagttttatgcgattgtttccctgctgctaacaaagatacagaggtttcctcagattcaagtctttagatggccagccacaccccagcctctggcctgtttctcttgttctttcttttctgtgtgtcactagtatctccccatcacataatatgcagtcatattttggctcctaccattcctaacaccacgctattgatttctctggcccttgttggtttagattagtgaccttcaaccaaacccagcggcctttcctaatttcttattcctttggttttctgcagtaatttgcaggtggtcctctcctgcttcctcctagaaactttcttccacttaccatttttgaactgactcgatccttgtttttctcctcttctgactttttggcctcctatattctctttatgtccctaccattaagtgtgagtatcctccaagactgtgtggctccctgttgtttttcctgaaacatttttgcatttgaagatgttggcctctcctagaatgtcactattcctaaactcagaggcttttccctaacctctccttagagatccaccctgcatttctgtttctaaactaacataatcattcttgccctctcgagaatagagtggccctttcttctgacagacatgactcagcacgcctcattgcacttacttttcccctcggctttgaaccaaaaatatccttccagtgggcttgaaaccttcaagttgctggaatccttccctggctgtccccacccctttgctgatttgatcctcaagtcctgttagttcttcttatagttacctccattatggccccttctcgatttattcactttagatgttttctaaaatgtcttgctctagtagatgaagacttagcttatttacttcaccccctgtccaccagccttcctcccaaagtcatcataggcacactgggaaatactgagggttcacatccagaccatcccaagaaagtgagtatcccagtaaagcaagtcacatgaatattttggtttccaagtacatgtaaaagttatgtttacactataccttagtctattaagtgtgtaatagcattatgtctaaaaaacaatgtacattaattgtttaaaaattaatttcaatttttaaattaaaatgtaaaaataccttactgctcgaaaatgctaatgatcatctgagacttcaaatcatatgtgatcttctgctttttttttttttgagacagagtctcactctgttgcccaggctggagtgcattggcatgatcttggctcattgcaacctccacctcctgggttgaagtgattctcgtgcctcaagctcccaagtagctggggttacagatggcaccacacctggctaatttttgtatttttagtaaagatggggttttatcatgttggctaggctggtcttgaacttgcgacctcaggtgatccacccgcttcggcctcgcaaagtgctgggactacagacttgagcccagccccataatctttttgctggtagagagtcttgccttgatgttggtgtctgctgagtgatcaaggtggtgggtgctgaaggttggggtgactttggcagttttgtaaaataagacaacaatgaagtttgccacatcaattgacttttcctttcatgaaagatttctctgtggcatgcagtgctgtttgatagcattttacgcacaatagaactgcttccaaaatgaaagtcagtcctctcaaatcctgctgctgctttatcaactaagtttatgtaatattagaaatccctggttgtcatttcaacaatgttcacagcatcttcagtaggagcagattccatctcaagaaaccatgtttctttgctcatctgtaagaagcagttcttcatcccttcaagtctgatcatgagattatagcagtccagtcacttcttcaggctccacttgtaactttcattctcttgctgctatttccaccacatctgcagtgacttccactgaagtcttgaacttttgacctttgggtcatccatgagagttggaatcatcttcttacaaattcttattaatgttgatatttggacctcctcccatgaatcacaaatgttctaatggcatatagaatggcaaatcctttccagatgttttccaatttactttgcccagatccatcagaggaatcactatctatggcagctggagccttaagcaatgcatttcttagataggaagacttgaaagtcaaaatcactgctttatttatgggctacagaatggatgttgtgttagcaggcaccaaaaaagttaacttttttatacatctcattcagagctcttgggtgaccaggtggattgtcaatgagcagtactattttgaaaggaaatctttttcttttttttttttccctgaaaagtaggtcttaacagtagggttaaaatatttagtaaaccatgctgcaaacgcatgtgctgtcatccaggctatgttgttgtagagcacaggcagagtagatttagcataattctcaagagccctaggatttttggaatggtaaatgagcattggcttcaacttaaagtcatcagccaccaacgaaagtcagcctgtcctttgaagctttgaagtcaggcattgacttcttctcccttgcttgagttggggaaaacagttgtcttcatatataggctttcaattgagataacactgttcagccc

SEQ ID NO: 819 - DNA, 26709 bp, Homo sapiens
tctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaa

SEQ ID NO: 820 - DNA, 30184 bp, Homo sapiens
tatgttcttgttcttgttcttgctgctcctatggctacagtgggcagaaacttaggggagtaggggagtcctctgagccaagtaggtgggaaggagaccctaacagaacggggagcattgggtgcctttccacagctcaccacgtcagccagatagagtggatgcaagctgtcatgctggagtcactaggggcacctagaacccttggtttagtttaattttgaaataacagtttaattgacatataattcacataccataaaattcaccccttttgagtgtgtaattcagtggttttagtatcttcacagagtttcacaatcactactaatttctgaactttttttttttttttgagacagtcttgctctgtcgcccaggctggagtgtagtggcatgatcttggctcactgcaacttgtgcctcccaggttcaagcgattctcctgcctcagcctccgagtagctgggactacaggcatgtaccaccatgcccggctaatttttgtatttttgtagagacagggttttgccatgttggccaggctggtctcaaactcctggcctcaaatgatccacccgtctcagcttcccaaaatgctgggattacaggtatgagccactgcacctggcctaatttcagaacacttttatcttctcaaaaagaaaccccatatccatcaacagtcactccttatggccccctccctttcttcccccaccccctgggaaaccacaaatctactttctatctttttacccacctaagcctcagttagataggttttgcctattctggacactttgtacaacagaatcatgctgtatctgtatatccctggtaggtgtctgtatctgtgtttatttgagaaactgccaagttgtttttcaaagcagctgcataattttacatttccattaacaatgggtaagcgttctaatttctccacattctcaccaacacttgttattgcatatattttttattacagtcaccctagtgggtatgaagtggcatctcactggttgtatttgccaaatggctaaagacgttgaacatctttttatgtgcttatagttcatttgtatatctgcattgtagaaatgtctatttaaatcctttgcccatttttatttcatttttatttatttattttttttgagatagagtttcactctgtcacccaggctggagtgcagtggtgcagtctcggctcactgcaaccccagtctcccaggctcaagtgattcttgcgcctcagcttcctgagtacctgggactataggcacgtgccaccatgcccaactaatttttgtattttttgtagagatggggtttctccatgttggccaggctggtctcgagctcctggtctcaagcaatcctccctccttggcctcccacagtgctgggattacaggtgtgagccaccgcacctggccctttgcccattgttaaacagggttgtctttttattattgggttgtaaaagttcttacatattctttttctttttctttttttctttttttttttgagacagggtctcactctgttacccaggctggagtgcagtggcgtgatctcggctcactgcaacctccacctcctgggttcaagtgactctcctacctcagccacccaagtagctgagattacaggtgcgcatcaccatacctggcaaatttttgtatttttagtagagacggggtttcaccatgttggccaggctggtctcgaactcgtggtctcaagcaatcctcctgcctcagcctcccaaagtgctgggattataggcatgagccaccacacctggcctcttttcatattcttgatacatgatttacaaataatttttcctattctgttggttgtctttttactttcttgatggtgccttttgaagcacaagcgtttttaattttgatgatgtcctatttatttatttgttttttgagacagagttatgctcttgttacccaggctggggtgcagtggcgcaatctcagctcactgcaacctccgcctcctgggttcaagtgattttcctgctgcagcctcctgagtagctgggattataggtgcgcaccaccatgcccagctaattttttgtatttttagtagagacgcgttttatcatgttggctaggctggtctcgaactcctgacctcaggtgatccacccgcctcggcctcccaaagtgcagggattacaggcatgagccactgcgcctggcccaatttatttatttttttcttttgttgcttgtgcctttagtgtcgtatctaagaaccattgcttaatccaaggtcatgaagatttactcctatgttttcttctcagtttcacagttttagtcttacattttagattgtctgtgatccattttttgttaatttttatatagggtgtgaaggtaagctgtccgactttttttttttttttttgcatgtggctattcagttattccaatcacgtatgtttaaaaatactattctttccctactgaattgtctggcaacttttgttgaaaatcaattgaccataaatgcatgggtttatttctggactctcagttctgttccattcatctatatgtctgtccttatgtcagtaccacacactgtctgaattactagcgctttgtagtaagttttgaaatcgggaagtgagaatcctacaactttgttctttttcagtattgtttcactattccaagtcctttggatttccatgtgaatttctgagtcagcttgacaatgtttgcaaagaagcctgctgtggttttgatagggattgcattgaatctgtggttcactctggggaacatagccatcttatgttaagtcttccaattcatgaacatgagatgtctttccatttatttacgtgttctttcatttctttcaacaatgttttgcagttctcagagtacatgtcttgtacttctttcgttaaatgtattcctatagactacttatttttaagactttttttttttttactgtatatgtttggtgtttccagaatttgtatgaattgttttggaattggttctggaagtaagcaccatgagtgagggcaccttgcctccatggggttgtggggttgtggggttgtggggtgggtagttgtagacatggtcagcagactaactaggggttagttttaaacttctctggtagcctgtggactctcctcttcttcatcaccaaaactccttatcacccacgcctcatgctctccccacacattctatgtgctaagtgctgttcctggataatttaatgctcagaataagcctaatttacgaggttttgtgatcattttacagagaaggaaattgaggcttagataggtaaagtcaccatccttgggagtcatggagcaggactgaaatccagacactcggacttgagttcatgctcttaaccacaatcctacacctgctttgaggcaatgtatgtgtttccctctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaa

SEQ ID NO: 821 - DNA, 35639 bp, Homo sapiens
atctattttctttttgcctaaaccttagtagttgagtctctggagacatcacaccttcattgtccccacctgaactgagccatccactcttcttgggaattttgctaatttcaaccgatcaactttccctccctccctcatttcaaacatcgtatctgcctctaccccatcttatcactctcagcagcaaactcgacttcacagagaaaacagaagccatcaagcctgcctgccccattcccaccctcttcctactcactccttttacaacagaagccagatccctcctttctggggtgaccagatttagcaaataaaaattcagaatgcccagttaaatctgaattttggacaagcagtgcataaaaaattttttagtgtggaccatactttcttttttatttttatttttcagagacagggtcttgctctttctcccaggctggagtgcagtggcttgatcatggcttactgcagtggcttgatcatggctcaccgcagtctttgcctcctgggctcaagcaatcctcccagctattcctcccaagtagctgggaccacaaatgtgtgccaccatgcccagctaatattttatttttttgtaaagacagggcctcactctgttgtccaggctggtcttgaactcctgggctcaagtgatcctcccgcttcggccttgcaaagtgctgggattacaggtgtaagccactgtgcccggccacatgagtaatacttatactcaacaatatgcgtgttgatctgaattcagatgtaactgggcatcctgcacttcatctggcagttctgcttctgtctcaggccagagcttccccttgcccgggtttgtgttctctcctgcctttattctggatcatccctccctcctccagtccctccttctctcttctggaccttctccataaatatttaaacatcaacttttaggtgatccaaggacactcagaattgatatatttgcaggtcaactttgtgatgtgtgattttctccctataaccttccgtctcccaggttcagtgaatggtactaccatgcagcctgaggaacaggctgtcagcaagtcctggcagtttcacctctttttttcctccagttcactgacttgttaaaattgcaatgacattagcaaacatttacaaaatacttactctgtgccaggctctgtgctaagtgttttatattcattaatttagttaatccactctataatcctatgagtctggtgtaattcctgttttgcagataggcagactgaggttactcagctaataaatgacagggctaaagatgggatctagtcatttcagctccatagtctgcttttaaaaattgctgccatactcaaactatatcatttcttgcttatagaatgatcacagctgccttgtgatccagtttttccattgcttttttagttctccactatagtcaaggttgcattttctaatgtaatagttaatatgttcaaaaatatgtatatgtatatgatggataaacaccttgtagtatatcatatatataaccatatattgcaagacttcgactctaaaaaaattattttttagtttcctctattttgaactttatgaaaagtgtcatgctaggtatagtcttcttaactaactttttcatgatttattcatgtaacttcaggtagctatggttcatacattttcattgttgtatatttcacagtgtgaacaatccatggtttacttatccactcttcagttgatgggaagttgggctacttccgttttttttattatgaacaatgttactataaacactgtcattaatctatcttggggtacatgtgcaagggcttcttttttttatttttgagatggtcttgctctgtcgcccaggctggactgcagtggcgtgatcttggctcactgcaacctctgcctcctcagttcaagcgattctcctgcctcagcctctcaagtagctggaactacaggcacccatcaccatgcccacctaatttttgtatctttagtagagacagggtttcaccatattggccaggctggtcttgaactcctgaccttgtgatctgcccacgtcggcttcccagagtgctaggattacaggcgtgagccaccacgcccaaccaagggcttcttttaggtaaataactaggagtaaaattgctgtgcaggatatcgcatgctcagctctacaggatagtgtcaaattcattatcaaaatggttgtaccaatttatatcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgtgtggctgagtttttttatttttttgtaaatatgggctctcactatgttgcccaagctggtcttgaacttctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaacacctctttatggtttctttcccctactttcttttgaattatttatccctttgaaattgctttcttcagttccttttgtattctggatactgattttttattgtttatgtacactaaaaatctcttgccctggttgtgtccaggtgggctgtgtgttgaattggaaagggtgcatgtccttgaaaggcagcagctactactcagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacgttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaatcctgatgttcaagaagaaataaaagtgagtatagatacccacacagacttctccattaatggaggtttaggtatttatttaaaacactttatattgcacagtaattgtgtaggcaaaatcaagtctttaattatttgaaatactctatagttatttgaaacactttatattgcacaataattgtgtaggcaataatcaagcctgaattaaatcccaggattaagctctctggtgcaaatgtagactctcagacatgtctgtgactccttccttcatctaactcagagtaccctaaatggaaggagtcagaaacacctgccaccctagctccaagttgccccgccacctgtgacagtgagctgtacggtgcctgtgacggtgagctgtgcggtgcctgtgacggtgagctgtgcggtgcctgtgacggtgagctgtgcggtgcctgtgacggtgagctgtgcggtgtctgtgacggtgagctgtgcggtgtctgtgactgagctgtgcactgtctgtgacggtgagctgtgcggtgtctgtgacggtgagctgtgcggtgcctgtgactgagctgtgcggtgtctgtgactgagctgtgcagtgcctgtgactgagctgtgcggtgtctgtgacggtgagctgtgcggtgcctgtgacggtgagctgtgcggtgcctgtgacggtgagctgtgcggtgcctgtgatggtgagctgtgcggtgtctgtgacagtgagctgctgcagggaggtgggtcatttggggtctggctcctgcatctaaaatgggcttcttgatggttatttggctttcatgtcttagctgtctcatctatgaaacacagttggtggcaatatttgtctcatagggctgtttggaagattagatgagataacacatgcacgacacttctgtactcattgagtaaatattaacatattgcctactccgtgccaggccctgttctaagcactgggaatgcagcagtgaataaaagaagccttaccctcaaggagtctccaatatactgaggggaaagcaggcaattagccactaaatatatatatgttaggtggtggtgaatgccaaggggaaggggcatcggagtgtcaggtagaagtggctcttctatataaagtgtgtaggagacaccttcttatgatgagatgctgtttggacaaaaacctgaagtgagaaaggaaccatgtgactatctgggggaagagaatttcgggcagaaagaagaacaaatggaaaggtcccgaggtgagagtgtggttcatgtgtttcagggatggcatggaggccagagtgtagggttgccaaacttagcaaagaaaaatacaggatgtccagttaaattttaaatgaatgatgcaacatttgagacatactgctaccaaaaaattgttcattgattacctgaaattgaaatgtaattgagtgtcttgtattttatctggcaaccctaccagtatgctggagtgaaatgggttagggcgctgaagtaagaggtgggggctgatcatttctcacaatacaattcacaaaacatatcagctatgttcttgttcttgttcttgctgctcctatggctacagtgggcagaaacttaggggagtaggggagtcctctgagccaagtaggtgggaaggagaccctaacagaacggggagcattgggtgcctttccacagctcaccacgtcagccagatagagtggatgcaagctgtcatgctggagtcactaggggcacctagaacccttggtttagtttaattttgaaataacagtttaattgacatataattcacataccataaaattcaccccttttgagtgtgtaattcagtggttttagtatcttcacagagtttcacaatcactactaatttctgaactttttttttttttttgagacagtcttgctctgtcgcccaggctggagtgtagtggcatgatcttggctcactgcaacttgtgcctcccaggttcaagcgattctcctgcctcagcctccgagtagctgggactacaggcatgtaccaccatgcccggctaatttttgtatttttgtagagacagggttttgccatgttggccaggctggtctcaaactcctggcctcaaatgatccacccgtctcagcttcccaaaatgctgggattacaggtatgagccactgcacctggcctaatttcagaacacttttatcttctcaaaaagaaaccccatatccatcaacagtcactccttatggccccctccctttcttcccccaccccctgggaaaccacaaatctactttctatctttttacccacctaagcctcagttagataggttttgcctattctggacactttgtacaacagaatcatgctgtatctgtatatccctggtaggtgtctgtatctgtgtttatttgagaaactgccaagttgtttttcaaagcagctgcataattttacatttccattaacaatgggtaagcgttctaatttctccacattctcaccaacacttgttattgcatatattttttattacagtcaccctagtgggtatgaagtggcatctcactggttgtatttgccaaatggctaaagacgttgaacatctttttatgtgcttatagttcatttgtatatctgcattgtagaaatgtctatttaaatcctttgcccatttttatttcatttttatttatttattttttttgagatagagtttcactctgtcacccaggctggagtgcagtggtgcagtctcggctcactgcaaccccagtctcccaggctcaagtgattcttgcgcctcagcttcctgagtacctgggactataggcacgtgccaccatgcccaactaatttttgtattttttgtagagatggggtttctccatgttggccaggctggtctcgagctcctggtctcaagcaatcctccctccttggcctcccacagtgctgggattacaggtgtgagccaccgcacctggccctttgcccattgttaaacagggttgtctttttattattgggttgtaaaagttcttacatattctttttctttttctttttttctttttttttttgagacagggtctcactctgttacccaggctggagtgcagtggcgtgatctcggctcactgcaacctccacctcctgggttcaagtgactctcctacctcagccacccaagtagctgagattacaggtgcgcatcaccatacctggcaaatttttgtatttttagtagagacggggtttcaccatgttggccaggctggtctcgaactcgtggtctcaagcaatcctcctgcctcagcctcccaaagtgctgggattataggcatgagccaccacacctggcctcttttcatattcttgatacatgatttacaaataatttttcctattctgttggttgtctttttactttcttgatggtgccttttgaagcacaagcgtttttaattttgatgatgtcctatttatttatttgttttttgagacagagttatgctcttgttacccaggctggggtgcagtggcgcaatctcagctcactgcaacctccgcctcctgggttcaagtgattttcctgctgcagcctcctgagtagctgggattataggtgcgcaccaccatgcccagctaattttttgtatttttagtagagacgcgttttatcatgttggctaggctggtctcgaactcctgacctcaggtgatccacccgcctcggcctcccaaagtgcagggattacaggcatgagccactgcgcctggcccaatttatttatttttttcttttgttgcttgtgcctttagtgtcgtatctaagaaccattgcttaatccaaggtcatgaagatttactcctatgttttcttctcagtttcacagttttagtcttacattttagattgtctgtgatccattttttgttaatttttatatagggtgtgaaggtaagctgtccgactttttttttttttttttgcatgtggctattcagttattccaatcacgtatgtttaaaaatactattctttccctactgaattgtctggcaacttttgttgaaaatcaattgaccataaatgcatgggtttatttctggactctcagttctgttccattcatctatatgtctgtccttatgtcagtaccacacactgtctgaattactagcgctttgtagtaagttttgaaatcgggaagtgagaatcctacaactttgttctttttcagtattgtttcactattccaagtcctttggatttccatgtgaatttctgagtcagcttgacaatgtttgcaaagaagcctgctgtggttttgatagggattgcattgaatctgtggttcactctggggaacatagccatcttatgttaagtcttccaattcatgaacatgagatgtctttccatttatttacgtgttctttcatttctttcaacaatgttttgcagttctcagagtacatgtcttgtacttctttcgttaaatgtattcctatagactacttatttttaagactttttttttttttactgtatatgtttggtgtttccagaatttgtatgaattgttttggaattggttctggaagtaagcaccatgagtgagggcaccttgcctccatggggttgtggggttgtggggttgtggggtgggtagttgtagacatggtcagcagactaactaggggttagttttaaacttctctggtagcctgtggactctcctcttcttcatcaccaaaactccttatcacccacgcctcatgctctccccacacattctatgtgctaagtgctgttcctggataatttaatgctcagaataagcctaatttacgaggttttgtgatcattttacagagaaggaaattgaggcttagataggtaaagtcaccatccttgggagtcatggagcaggactgaaatccagacactcggacttgagttcatgctcttaaccacaatcctacacctgctttgaggcaatgtatgtgtttccctctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaa

SEQ ID NO: 822 - DNA, 35679 bp, Homo sapiens
ttcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttactacgaatgtctaagcttcaaatattgaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcattagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcacttcagagtgttatcttctgagaagaaggtttgaattcataactggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaagtgtacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggtgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaaga

SEQ ID NO: 823 - DNA, 34268 bp, Homo sapiens
ttcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttactacgaatgtctaagcttcaaatattgaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcattagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcacttcagagtgttatcttctgagaagaaggtttgaattcataactggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaagtgtacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaa

SEQ ID NO: 824 - DNA, 317549 bp, Homo sapiens
ttcatcataatacactcttactcctaaaagagattgctgtatcataggacatgtgtgcatatgaaattttatatttatgttgaaaagttttgaggagaaaagaagaatcctttctctaagtaactttatagattttgtttttaattgcacgcatacaacaagttctcattaattataaattcagttcgtgggcaaaatatattttctgtgtgcccctttctataggaaacttgctggattatttctaattctgagtctgtatctgagtaataatgacaataagtaaatgatcccaaatatatttatataagtaagagattgcattctagaacttattttttgaataattttctataattaaaatgacaaacacttttgcaatctgaatttcatagtaaggataattctaaacaaattttgaaagttttggttttagaagaagttcaagaactatttggctctgcacggagagcttacacaagttgtatctctaagccctagcttcttgctatgcctttattaacataccagttttggggttaaaaacctactttagagctaaaatattttattaaaaatttaaaaaacctactttagagataaatattttattaaaaatttatcagcctgggggatatggagtggtagagagaattacttcccatggctgctcccttgcactgtttgaatattttaccaaatgcatgcattgcctttccaaaagaaatggaaatattttcaataatcaaatcagtaaaatttctgatgcttttcagttttttatacctacttttgcctttttgaatattctcaagaatggaactagacaaatgtaagtgataaattagagagaagtgactttaacttaaacatgcatctgtgcccagacatacccttgttaatttattaatattttagacaattgtcagaatctaaagtatttccagttctcaatctagaatggctaagcttatttttatggttctacatgccacttgacaataaaagatcatttatgattctaagaagcatttgtctctcaagtggcattgtaaatcagtacaatcttttgaaaaggaatttagtaacacatttcaaaggccatgaaaattccactccctgtaagtgaatgatttcagtaaatttaaaagtcaaacattagaaggcatgccatgttgcctttcacaaaaataattctgctaccatccctggaagctgttgttagaaggtcatgttcaataagcttacaatgttttcctgattgttgtttgtgtgaccattaaaatttcaccagtattggggaatttttacctttcagatcatttagttccaactgttaggaagcaattagctcttatgttcttctggttcgtgaaagtattttactttgggtgcaggagtagggtctctggggccatggaatgatccacacaggccctggcatgggagggactggttccatctcaatctgaaaatcagacaaaggtttatttcttacttctgttatgcaatgttggcaggttgttctgactcttttccagttcctgaatattacttgttgtataataaaaatgatattctaactaaaaattttaaagaaaaaaatttgcaatcttgcagtttaatgcaaccatagtcttagcatttttgtctgtgttctcttttcaatctttgtttataaacatatatgtttctacatagagctgattgtaagaggtatagaattccacactttataaatgccttgttaatttattgttttccatgttgtcacatagacttcaggggtctcctctcaactgactgcaaattactcactgagttggtgccccattatgtcctcggtcatttcccctatcgttgagcatttacaacttttctaatgattgacttttaaatttcttgaaattattgagttaaagggagcagaattttaacaacttttgttatgtgtcactaaatcccttttcaaaagattgtactgatttacaatgccaattaaatgttttacaagtattattttccaactatgtgaggattatttttgtttatttccatatatctctatctctcctctccaaccagccaaaaaataaaaataaaaataaaaataaaagtactcaagggtgagttaggatatagacatacatatatgcttatgtgtttacatttactacgaatgtctaagcttcaaatattgaattctacagatattctctcactgagagacaagaataactgacttatccaggctgcaagtctggtgcttgttctatttgatagtctgatgctgtaagttttttgtcacaaactctgaagagtaaagtggaaactttgactttttgcttctgattgcagatttctatccaaagagggagttgagggaaatgcttcctgttgtcctaattacacagtactaagtgaacactggatatggagtcagaagggaaagtagacttgtgagcccatcacatatggagaaaacacttttggttcccattgttggcagggacagggaggcaggccatgttgcctttcacaaaaaaaaaaaaaaaaaaaaaaaattctgctaccatccctgggagctattgttagaaggtcatgttcaacaaactcgcaaagtgttttcttgattgttgtttgtgtcaccattactcaacgttgtgtagaatgtagtcaggtgatattatccccaattttataccgagacttattttaggtggattatatgactcagtcagaatcgcatcaaagcagaaccagaaccaagtttgttttcaactccagtgcttctttccgaagttttatttccattgtcagccacttaactattttaaaacgtatcttttggaatagggatctctcaataggaatccacagcaaagatgaagagaaaactagatcagttgccttggcaattttgtccactcagaccaggacattcagggatttctagattgaatttgtgtttccttctgactacattgttgaaatgatctggatcatctcctaatcttgctcttggactctctaggtgtattctcagtgtctgtgagggagggcatgtgttttaagcagtaaattcctaaaggcctgtggaggcccaaggccatgcacactgagggagttgtggatcaagtggcatgatgggcccagtctatttctggcagagctgttattttagctgttattctctttggccagttatctcccttagagtagtgcctctttaaatgctttttcatttggtgaaatctaaaaatttgtctctaaaaggcatgctgccaggcctcttttcatattaaagtggtcatctccacattgtagatagtaaatcatgttcaaagaaaagaccttaaaaattcttcatattgccttgcagaaatcacagtattttagatgtgttggggagcttcacaatcactcagtttaacccattcatgttacagacagggaaactgaggcctggtgactttcccagttattaacaaggtagtgactgagaagggacttcagttcgctgtttttaatgactgtatagtgagcatctgatgtttggtcttctacagaaagggaacagagttgactaaagtgaaaataccctagttcagacatcagaggcaaaaaaattaatcataatcacaacagcaccttacagttgtggagtcctttatagtttttagactcttagacacagagaaatagagaaatataaatatggaaaataaggtttatttgatattttatgaaatggaaccctaattcaccaacatttttacccctttatagtactgcaataatttgttgtgagactctgaaatcgtttctgaattatcagaggaagaaaatcatttaaaaaaggaaaccagagctactggctctatcttacttcggtcatggtcttttaaaatctattcaatttattttaactagactaattcattcttaaagtaagtcagctaacatggaattttctgaggttacttaaaaaattttggaaatttccttagctctgcatgaagtatttttatctcttcttcttcttttttttctaaagaaatagtgtttgtgggtcttgataactgcccacaacagattttatatcatctggttttgatagagcaagggggtctaatgaatgattgaaactaacatttataaaatctttcaaatttgagaggcaggttcttggaagaaggaggatacaacagaatggcctctgtgtcactggtaggactctgaagacaggacttactgcctatgttccgacatgaagaaacagactagtgaagtatgttgtcaaaactttgagaattgtaaagcaatgttcacatgtaggttgataaaaataacagaagaagttatgttaacctaggtccgaccctaggtgctgtcatgttgtcactaccttcataataagcttcaaagaggtgctctgttattatctttaaaaattacagacgaggaaactaaggtttagacagtgttagtaacttgctcagggccagtcactcaatgtgtggcagagctggattccaagtcagtgctgtctggctctaaagcttagattcttttcattgcacttttattattaaaccaaagaacttatgattaaaatattttctgctttccttgacgatttatttcaagatctaaccatttctttttcctggacattctgagcagggagcactagctctcaacttccctgcctctaccctctggctgggctgcaccttctcctgctgcctgttcctcctgcttcatcagcacacagtgggactatacattagccagggtgttagacaggccctccctggaccttgtcttactttcccccttgtgttatgaggacaagctctgtagtaactacattgagaatcttaggagcaaaggctccccacccccatgggggcacgtcagtgacatttggctcctccattttgcttaagaaacctgtgaccagaccctcaccccaggcccatagtgagaaaagcctgttttcatttcttctttcaccaagcccatctggatagagcaggtgcagggctaggctcttaaaatagaagcccttgtttcatgtgacgtggcacggtggaaactcccttgcttccttgcctgttgatcagattaatgaaatgatgaaggtctctcccctcatcgtggtgttttcttgacttcctgtcattgtcagttgacctttctagtttcttcatttgtaaaatacaggacttgttcttcataacctcaagggtccctcctatctttgataatctgtctccatgcttccgattaggggtcagattttggaatttaccatttctatcttgtttatttctcccagcaatattattccagcaggaatagctgggactaaaacttattcttggttaaagcacatcatctcaccatcttgacatcccatttgctctataccatcaaccatctctgaccctgaaccccagtctccttctttgtaatttaggaataataataccttattcatggtgtgaatcatatgagagagaggatttaacattgcttagcaagtgatacacattaggcattcagacaatgcttgttcacttggggtcaaataataaggtccattttctcttcatgacttctagctattgattagctttgaggctgaaaaataagtttaagatgggccctctgacctcaagaggctagcaatattttatcttctttttaacgctatctcctataggaaggaaagctagcaatattttggataagacaaaataaatacatatgaaacagagaatggattaagtctggaaaatccttccagtgctacacctaggacaaggtaccccatgcagagcaggtaaattcttaaaaggatggtctctgagtcaaattttggagagtgaagtgccagcatagctgatcatcctaagaaaaagtcaagaccgcaagttatgggttccaacagtggagaaaaggctaaggaaattatgcactgttagtaagatagaatgatgtgcaccattcaaaatggtcaatatgatgcataagtagaaaaaaagaagtgctgtgaaacaacagcaagtgaaagaatttgaacacaaaattctagtaatagtgtcaatggctatgtatgaagatactcagataaatgttagaaaagaatataatgtgggaaatgaaaataatagatgtgttagggttatgggtttttggatgaatttcaaaaacattccttttattaggctttcacttcttaagtcaaacattttgaaaaatttcacattgtatgacttggattgcataatataccagttcctgggctaaggttccatctttctctggggcaggatttcctctctggttttcatcgtgatctctgcctttgaatggcttgctttttcttttaagagaaaaaagtatgacaaatccagtaggtgatggaatcctctctcttccatttatatttctgtggatcttccttctcaaattgcctataacttcatattgaatctgaagaaagggagagtttctaggagccctgatataagggctcagggatttgtgctgccatttctttagaaaatgcctgattttcccaagaatgggtcagctctaatggaggtacctattccttcaaggaaaagcagtcaacttagcaaacaggtaattccagaggtgatttacgttttactttggcagatggagccttcattttcaatagaactccctgtgaacttcctttaaaagtgttttgacttttctggaacacatggactccatgcagtgacgtgcccggtaggcagtaatgcatacttagggctggccttccacagcttgagtaggtgggttccctttaaatgaaacaatctgaagagatgcaacacaactgtgacccttggtggtcttccagcttttaatctgattcaggccactcatttcaaccctatgcaagccaatttgacgcaaatgagtccaatctaaccagtccaaaaaatacttgggtgtttgtgccaataaatctaacgatcaaatcattcccccttgaattagaagttaacaagacaggatagctcatactgccctctagtcattcctgccaccattaagaagcctggggctctttcttaccccatgtgccaacttctcagggcctccttgtctaattttgcttgagaatgtagagtagaggaaggagaaatggacagacagcctagagaagtgacttacagtctgggttcagctctaactactaatagtgttgaggacgtcagtcagcttctcgaagtctcagtctccatatttgttaaaataaagagggtagtctggtttttctggccccttctctcctgtcctcctagactatgaattcatttttagctttttaatgcaaatttttgattcattagaatctagcttcttcactctgccacttttagttggctcttcttagagcattagtgcccaatttgcactgttagaattttcccttgtttgtacccttcaaaatttttctttttttgggcaaggattgtatttttttctttttaactggctccttgaggatagatgttgtgatatctgtgtgcttgtatgtcctcaactgtgccctgcactgttagggcccttgtcaaaacaacacatttctcagtgattctgagactctttctcttatctatagaagtcataactcaagagtaaaatcataccaatattttacataaaccctagaatttttatagatctattatttctttttagagtacatattggaagtaacttcacaaggaacattttctttacttttttttttggaaaaaagatttatgcttataaccaaatgaggttgtttggcaaatttgtctggagagacacacacactcagggcaaataggcactcctttcctgggcaactcaattacctcttgcctctggtcaaaccactccacaaataaagtggactgatcctcttgactctatgtgtaagtgcccattgtgtgtgcacagagctggtgagaacggccatggtgctaggtgggggtggtgttggtggagttggactagattatctgggatcatgcgaaatggaaattcatttctagctggctggcttcagaaggtgccatctcctatttttatatgaagcgtgctttggaactcagggcaacgaagggtgggtgtgctgcacaaggacagcagaagagtgagctgactggtccctgaaatcgcagttggaaagtggattaccagtgcagtagaactcttcacggaggcctggaccatcaggtctaatggtgttgttccaggtgggtggtcatgtggagcaaaaatatttgaaatcagcgagcacgtacctgagagatgacttttccacttgggctagtctcttgatatttctggtcctgtttcttcatctgtaaactgggttagtaatgtcacactctgtgagttggtgcatccagataacaaacaaacaaacccacacacagaaaaacaatccccataaatgccctataaacttatattaatcatcaacaattcatttatttgttcactcacttatttattcaacaaatactcgtatgaccaaagcactgtgctttgtgctaagctctacaataaatatagaattgtataaagatcaaggagtaaaaatcctagttcaggtcctcaataaatgataggtgaatcatagactgaaacgtggaagtaaagtaaggaggtcttccacgactattgtgatcttcaaatgttcttttgggtgcagagtttccccgggaaactgccagtttctataatggacaaaagactttgcttttcaggagtatatattttgataggaaataaagatagaaatacttggaacttagacaaattaaatacataaatgatggatagtatgtagggaatacagtactgtggggaatcaaagagagggtgaattctgggtgaaatcaggagggtttctcattattcacagatgatctcttacaggaggtgggaatttttaggtcagctggaaatggaaccaggctttcatgttcagatatacttgcagataaacaactcataagaattataagactaacagcttcgttagtttacatttgacaatttatttgtgcctcattattttgggatgtgtcaagaatctgataacatgggtgataatgctatttgccactgtaatatcaggtagtcctagtgaaaatgcaacttttaagaacttgtttaattgtatctaccaactcttactgcagaatgtagacttgaaagaagcacattcctttttcttacataatcattaggggttactacatttctgagcaacaaggctcaagagtttccaatggaaatgtaatttcaattagaaaaccaaattgaggttgagggtggagagagccagctgcagaaggtatctggacagcagcatgtatctgcaggcctgcgtgtgtgccagggtgggggcaaggaggggtagattgtgtcattttccacatatgtttatttagcttctcctgtttcagggactttgggttttattaatagtcaatttaggatattgtgcctccatcctcaagcattgtcaatcttaaaaggatgggtgggagtggtaggcattaagcctcagaatcttctagccctttggctggagtggttctgtctgctattgctgcaacctgaggaaatctttcaaattctgggtgggctgctctggttaatatagtggagactctaacaaaaattatgtcatccagcaatagagctctggtgcagtgagtggcagactaactgatgaacatctcaatgcacagcaattctcagcagccctcagccagggcactcctagggagggcctctggttacaatgctcttcagagcctgcccagtctgtctctgtttctctgtcttttctttcctttctcattattcccatcactattattgtttctctttctctaaggtctgtatattatcctttcccctagttctttgaaaaatttacttcagttgcacacacaatagaattaaatgataaacatcaattttctaaataaaatgctgtgtacacccacactcacacccacagagtattttctatttcttaacaacaacaagaaaaacaacaaaatgcatagtaagaattaaaaaatctggaggaatattgaaggccagggcagattatttgtttagattagtgatccttaacccagaatttcctcacatctagattattgtctggtggatgacaaaggaaaatatatattggaaacccagttgtggatccttgagaatacagtagaaagaacagtgaaaattgaaagggaaaaggtgagaaaaccttcttattcatgtccaggaacagaattgggcttgaatttggtggctgcagctctgaacggactcaaagtgagtgtctgtaaatcctgctcagcaacacgaggacaggggttgccatgtcctcctcttccttatgtaccttccctcatctgcctccctatctctagcacatggaccaggggctcataaatgtctgtaggatggaaaaatctaggaatacatgtggggtcagaagttgtaagagattgggttgaatatattctgattccccaagttgtttttgtctacttattttctttttcttctctgtgatggttctttttttcttgttatttgtatctttgcacaatgaaagacaaaaaaaaaatagttctagtcactagaggacttcagtaaacatgctatcacttacctgcttatgaaccaagaggttgggaaggcaggtctcagttggcatgtagcccgagaagagtttgtcacatcttagagtctagaacctcctttcccacagagatacaaaacacacagttaactcactggtattttggctgggaagatagctgaatgatagcaccactttaaatcatatagtgatgactgctgctgatgatgcacatttcttttcagtatgaaatattagttttttgggaaatccaatgttcaccctaatcttgcagcattttgtaatttccatcatggcactgagcaggaggcaggatgggctgaagggaaatacactgaactgaactggatccttaggcctgtgggtgagacacagtattggcagatagtgccttcaccttgtggctcagtttcttcaggtttcaaaattgagagacttttttcacttttacatgttaagtaggtaaggatgaacggaaggattgtgatgtattgcatattggaagaaacaaaggtatcaggtcaaaattaagaagggtttatttgtggaattactgcagggagaatatccactgagctcagccattgaactcaagaacctgttagtaattaagaatatgaaaagattgtgaattgagcaccttctctgcaccatgccccgtacaaagtggattatacacaatatttcatttgctgttcacagtgatgttgacatagaggtttattgttattgctttattataaacaagtaaccccaaacaaagaggggataaaaaagtgatagattcccatgtgagagctcactaacccatggtatcccaatcagagggctagagcattggaatgacgtgtgaagacactgttgatgttaggtaattcccaggttggttaatgtttgggcaggaggggtataacttctctggcctccaatatgtgttaggcaccccttctgtgtgcttacgtagagctctgtaggcactcctctcagctccatttctccatgttgcaatttctggttatttgtttatacactactctaggagctccttgaggtagagagttctgtcttgttgactatgttatctgcaaatcttcatagagagccaggtacatggaaatgctaatacatttctatggaattagtgaaggtggacattcatacgtccaggcatatgaacaggtttttctctggagttggtgttgtttggtgtagaagggctgtcaatgagccttatgacttgaggaaggatcaacagatgggtggatagaagtacagatggttatatgcatggatggaaagggaatatggtagaagagaatgcttctgtcatgggctctaggaagtttactgaaatatattctgaaaggttgatatgtatagttcatccttattcttcccagcctctcttttctgagatgaccaaactattcaacataaatggtttcctgctgctcttaaatatttccaggacacttctgggtctcctgaagcacctgcttgctcacagcttcattctcacgtgaagtctgcataggtcctgttaccatatcagaactcttagaggacacttattctgggctgaggttttccaaggtgagaactccaggactggagatggagcagtgcatttaggtgaagtgatatcaaacaaggttggggttggtgttacttcccatcccagtgctggacacagccttggccaggtcctgttgtgaccccaggtgcacggggccttgggaacttctgaaagggtgtggagtgctccacccagccctgttggaggaggatgggagcgaaagcaacagatgtgctcaaggttctgttttcagttccccaaagggtcttctccttgaccaaagcagtgtgacggttgctatgacagttgctatcttggtccctgggactctccctcataaggtagcattactttttttaatcttctcaggcaagtaaccatgaaactctgtaataaccagtctgaggtggggctggttgggggcatgtttgggcctgagtactgggatgtgatggtggaatatgctggggtaccaagaggtacctttgattaatgagttatttttccaaattagaccaacactcctcctagttgtcttaggcttgatgactctccatttctgcagaagttcagaattcttcccttgagatgtctgcaattagttcattgttgcaaattataaaaacataacaggtagaaagaacactgaccttgaatctcaaatctgtctctaccaggtcatgtcattcagtctctgcttgggtcttctcatgtgttaaatgagagctttgatttccaagctccttttcactctgagagtcactgatgttttgcctctgaaaatggcaaccatgaagagtagttactgagaaaccagcactgtgttttagagttagggctcttgatcaggctgcctcattttgaatcctgatttgggaatttctgatgatgtgatcttggacatggtattgactttctctaagtcttagtttttttttttttttttatctgcaaaagagggtaaaacaagctaccccagaggctgctggaagattcagtgacatgttgcttgtcagtgttgagacattgtatccattacaactatcatagaataaaaacctgttacaagttggcatgggccgagctgccagcaatttcatacatctcttttatgcctattttgtttttcattttgatcatcaatattttaatggtgtgtcataaattgggggctctttcttatttgttcttggacccatggtgaaataaaagcttgtatatttttttagaaggattcatagagatgaaaggcccttactgaacattcagtctgaccttattagttttaaaggagctgactgagacctaactgttattattacaaactgatattattggaaaccaacacagaacctaccatgtgcaaaactgtgggaaaggcttggaagtctgggtttgacaacctgagtttaaatagtgattctttgtcttactagctccgtaatcccaaacacgtaatgcaatctttcttagtctgtttcttcatctatgagacagggctaatgagaaacatctcagtgtatggtatgacagcaaagggggtcatacaggtgacagtgctagcaaatgtcagtcccctcctcttctctacctcccaactcccttgaccctctcctctgtcatcccttttctggctgcgtgcagagaatcttgctagctttagggatacaaaaggttccagagttgggagacagactgttctcatacagagatcaataaccacatgatatgggtagtaagggccattcagatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcaggtgagggcatgtctgttggggtgtttatggagggttttttcagggaaagggtctgcaaatggagccaacaagaaaggaactggcaggtggtcaggatgtcctcctgtgagagtcactcttctccccatcctctctcctcttagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgtagagcccctttgtccttccagtgaccacctcatttctctccttccctcttctaattctctccttgaaagcattgtccatgcatgctctctccaatttcttcgctctcattctcttttgaacccatttggatcagacttttgcccctggcattctatagaaactgcacttgtctagttcaccagtgattcccaatatggctaaatccaatggcccatttccattcctaatcttggttgacttgtcatcagcaattgacacagttgatccattttttcctctttgtaacatttttcctcttggatcctaggataacaacactgtcctgtttttttcatctccttctctagccagtctatttcaatcttcttttctggttcctcctcatcttgctgacttctttacgttggagtgcctcctggctcagtgcttggatttcttttttggtatgtcgttgctaggtactctctcccagtctgatggctttttacaccatgtgtgtggtgatgacatcacgtttgtgtctccagcactgacctcttgcttctgaattctagactcttatagccagttgtccatctgacatctccactttgttgtctaatagacatctcagactcaacgtacccaaaacagagctcctaaagcttcaggaatcgagactgtgtctattgacataaggataataaaattgattaggggaattaaataaaatagaaatagaccaaacttacattgtcatttgatttccaacaaaagcaccaaagcaatctaatgggaaagaaaagtctttacacgaatagtgctggaattttcagcagctcatgaaatgtatatatattttatgaaaaaaagtaaaaataaaagtaaaaaatggtgctggaacagctgcacatccacatggaaaaaatgaaccttgacccttacctcatgctatacacaaaaattaattccaggtgaattaaagttgagctcccaaacctatgcctatgttctatagacttcttcatttcagttaaggcaactctatccttccaattcatcaggctgaaaaccctggattcccccttcagttttctctcttccccacatcaacactagcagtgcttcctggcagggctactttcaaagtagcttcatctcctgcttggattatgtaacaggctcccaactggggtttccacacatcttcctatcccaccctggatgggttattctcatcagatcacccagagaaatcctgtttatgtatgtcagatgatattattattatttttattatttttgagacagggtctcactctgtctctcaggctgcagtacagtagcacgatcacagcttactgcagcctccacctccctgggctccctacctcagcctcccaagtagctaggactacaggcacacaccaccacgcctggctaattgtttgtataatattttttgtagagacagggtttccccatgttgcctagtctggtctcaaactccacccacctcagcctccctaagtgctgggattactggcgtgagccaccgtctccggcctcaatattattattttgctcaaagcctaccagcctcatctcacttaaaagaaatgcttcctgtgacccacaaaacccgacatgacctgccctccctataaccctgtgtcatgagcactccgggcacatgcccacctcagggctttttatttgcagttcctgctgtgctcttacctatttatccacatggtttacttcccacttcatttaaatctttacctgaatgctaccttcttagtgacacctttcctgatgaccctgtcaaaacttataaccctcctccaacaattcctgcccttgctttaatgctctgtttaccccgtcgttatctaaaatactatattttaaaatttatcaatctttatcatttatctccccagctagactataagcttcacaaaggcagggagttttacctgtgtgatagcctcaggatcaaagacagtacctggcacatttcaggcattcaatacatacttactgaatgaaagaataaagtgtggccaggcgcggtggctcacacctgtaatcccagcactttgggagactgaggtgggtggatcatctgtggtcaggagtttgaggccagcctgacgaacatggtgaaaccctgtctccactaaaaatacaaaattaaccgggcatagtggcacatgcttgtaatcccagctactcaggaggctgaggcaggagaatcacttgaacctgggaggcagaggttgcagtgagctgagattgcaccattgcactccagcgtggacaacaagagcaaaactccatctcaaaaaaaaaaaaaaaaaagactaaattgtgattgaggtttacagatgactggtcagtgtttcccatatccccaaactgttttcctgcttgatgctattatttcatggggcaagttcaatttccttatccattgcttgactgtccaattagattggcagagcgttaatggcaaggactgtgtatcttatcttgtactgttctatatcctccactattgctgccattgtgagggggaacaagggagtggcttccctccatccagttccctacatcatatgtcatatcatacaaatatattagtatttataaatatattaggtctacctccttctctgtgcaaaatatgtcatatcaatgtctgagttctagtatgttcatattcttgggcaattatgtaattatggcttatgttgtcataacttctatgcccgtatttataagaaaaaaatattgagagcatttccaggaaaataattgactggaagaagagagagtggtaaaaaggaattaatagtgagctaactatcagtatatacaagcccagccttctaggatctggataacccgaagcaagaatttctctgtcagttttctcatctgtataatggtgagagtgggggtgttgaagtagaaaaatcctttgattaatatttattctaatccttgactaggtgctcagtgttagtccagggaactctatcttatttcttcatgggccagcttaatgtcaagatccaaaactcttgtgtaaagcttgggaccattttcaaggatacatttagtagtttacaataatctagataacactgactgatagaaatatgcaggaaatacagaaaattataatgtgatccacatatataatttagaagttttcactagccatgttataaaagtaaaaagaaatctgtgcaatcaattttaataatatttttgtttgcacacaagatatacagggtaatctcaacatgtaatcatataaaatattaatattttacacgtattttttgtacaaaatgttaaaaattggatgtgtttttacacgtatagcccatcttagtatggactggccttatctccagagctcaataactctgtgtggctagtggcaggatattggatatcaagtctagaacatacgtgaattaattcaaggttcaagcacattaaggctgaaagagttatgactgaagaacaagttcaaggaggaaatcaaacaatagccaaatttcactgagctactccttccattactaatgataacaaatatttatagatcccttagtatatactaggcctgatgcttagaactttatatgaactgtttcatttaatcctcacagcaatcttacaagtaagacctccaccccctttcagatgagaaaactgaagcacaaaagtgcagtaacttgctattatgacttgtgagcatattttcccaggcaattatatgcacagtatgatgtaggtaaagcagcccaataatttattcactatatttctccatgctcatggtaaggactgacttgatccctggtggtcacccacttgtgctccctcagtgagggaagggctgcagagcccctggcccgtgtcctagtgactcaggcttgggatctccagcagctgctatggttgacaatttagtttagtaaaatgttagatcctaccctgataactgttataaaaaatcctccttccccttccccagcacaggtacccagcccaaggggcactttctatggaaagatgaaaagaactgacatggacttgagctcactgggggtgcaggtttcaagaaagaacaaagagagctgttaggttgaagagacgcagttgaagagttaagtcttggaattgttaatacctggaacaaggcacggtgtgaaaagacaaagaaacacacaaacatcaatctgtcctcctcttttctctttctgtttcatttcttatcctccatcagtcagactttgcttcctctttctcctccttcacctcctcctccctgcccttcccaatttctttctatcttccatttattgttcttccaaaattcgtatactcatcctctcttctccctttctcttttctccaaaataatatgttcaacttactgacttgctcagggacttgtgggggcgaatgtattagcaccaaacctaggaaacatggcgaattctaaaaacttgttctcatagaaaaaagagttaaaaatagaaagctacagtccagttttgaagccacagaagacctcactctgatgtatagacattagagtcagaaaaagactttgaaaagaccagtgaagctccttgtcccacagacagtgtgagggagggacaaggggaattgtgtgcccaagcgtacttgggatggtgtaggtggctgataagagtgtcagtggaggtggtggttagcatttggagtgccccaatcttgtgacactaaacatttattgttatactaaccccactgccaactaccaggaagttttcatttttcttactgtgtcttagtctccatggcatctataaactgttttcccccaatgtccaggcatcattcctctcccacagttgatgtctggctctgtgccatgggtgtgggcctgcctcttctctctcagaatgactgctgtttcatgcttggtgagccacgcagtatgccaagctgctgtctctgacctggagaaaggatacccatcctaccacaggtggggcatatcatgggatggccttcctggttttccttggcagacacatttttctcacttttttttttctctcctcccttctctttttccctccctctttgatttcttctcttttccttttctttctcttgcctcacttctgccctagatctaccatgggacccagggagctttggagccatgcaacccacagtgtgctaagctttttactcatgctatttcttttaatcttcacaattctttacctatcaggcattaccatcagatctgcaccttacaggtgagaaagggaggcccacaccgattaagaaatgtgctcagggccacacagcctgtacatgtcagagtaagggcattctcatgccaaggttcattttcagagccaaaagcataccacgtctcaggagaagcaggctagatctcttgtctgcttggcttttaactcatgctgacctgaactttctggatttgagtaactctcagacctgtggagcccgatttctgtgagtggattttgccagccacctggggaggtgaacccttgctggggtatggctcattagtgtagaagggagttccttcagaggtacgctgtcttctcggccatccccattgtagtagtttcttgggtctgccctaacaaagtaccacaaactaagagccgtaaaacaacagaagtttattctgtcataggtctggagacagaaatctgaattcaaggcacaggcagagttagtgtcttctgcaggttctcggggagaaaccatcccacacctctccagcttctggtggctcccagcaatccttggtgctctttggctctcagctgcatccctctggtctctgcctccttggtcatgtggctttcttcctatgtgtcactgcatctccaatctccttcttcttataaggacaccagtcattggatttagggcccactcggatccagcataaaaaaaaagtttaaaaaaattatttggaaataattatagattcacagaaagtagcaaagacaggatataaagcacagaggtctgatgtgtcctgcacccagtttctcctgttggttacttcttacgtaattacagtacgatattaaaaccaagaatttgacattgataaaataagtgtgtacagttctatgtcattttatcacatgtctagatgcctgcaactaccactgcaatcaagatacagatttatcccatgatcacaaagatctccctttatagtttcgcctactcttctttctccaccaccctaacccctggcaaccagaatctgttctctatccctataattttgtcacttcaacaatgttacataaaaggaatcacatggtatgtgaccctttcagattggcttttttcactcagtagaaagtccttcagaatcactccagttctctgtatcaacacttcgttcctttttattgcctcatagcattctatggcatggatatattacaatttgttaggctagttgcctattgagggatgggttggctctttctagctttggctacaacaaataaagctgctgtgaacaatcatgtatgggttctgtgtggacataagtttttatttcctgggggtaaattcccaaggagtacaattcctgggtcatatggtaggtgtcttttgtttagtttttcaagaaactgacaactattttctagagtagctatacccttttatattcccaccagcaatatatgaatgatccattttcaccgcatcctcacaaacatttcagtatgacctaattttgacttgattacctctgcaaagaccctatttccaaataaagtcacatttatgtgacccatttatgagtaccaagagcaaggagttgagcatacctttttgaaggacacaattccacctgcagcacctgtcttcacttgcttaggttatgggtgggtttcacttcagagtgttatcttctgagaagaaggtttgaattcataactggattatgcctgcctttgattgttcaatttggcccccagggatgagtgagcaagttcatgtcattggaagggacattactgagtctcacccctactcaaacctccaaagtttgaaagatttgatactcatcaacattctcaagaggcagaagggcaaggtgcttccttatgtagtttctccatgactgtccttccccactttcccagtactgactggaaagaaaaacaaagcaggacaaagggattgtcagtcatttgagggaagggatgctgtgttagttactcctgaaccccttcagagtgtaggcagagagaggtacttagaaaggtgtgttggatggatgagtagctgagaggggcagggccagagtgccccatagaatgaggaagagtcctcatttacatgtgcccttcccccttcccaaacatgtgagtgttcatacatgggtttccagtgtctgggcaaggttaattctgtcctctgtccccttgctgaaggtctgtttcatttaatttctatgtatgtgtgctcctagctagccaaacagggcacagatgccaggaaaatagcaggcctgttgttttgttgagcaccttgagccctggaaggcagactcattcagggctcaagagggcaggattaggcaggtagctatttgatcccaggcccccccacttaccagctgcgtggtcttgacctattacttattcctcttctatctattaactgggtataagatgttctttatgtgaagttattttgaagcataatgtgtatacagaacagtgcacagatcataactgcacaaccccacacgaggaacagaacattaccaagaccccagaagccccttcttgtcttctcccaggcactaactcgcccacccccagctaagagtaatttccatccaaatttctaactttatttttacctggttttgaactttatatggatgaaaacatacagaacatatcttttgcattgagtttctcttatgtaacattatttttatgagattcatctgtgtgagtaggtatagttgtagcttgttaattctcctcattgggtattctaatgtataaacataccacagtttaataactcattctattgttggacaatcgggctatttccaatttttggcttttgtaaataaagctgctttgaacattcttgcatagttttttggtgggtggggacactcagtcatctagaagtgggattgctgagttatagaatatatttgtctctcagctttatagaacctttgcaacattttaatgaatgtttttaatctcacagtatagtgtggattaaattaggttgtggaaagtactcaatacggcccttggcagacaggagtccctcagtacctgtttaaaaatgtaaataaggcatgacattccattaagtctaagtaccatgatgaacttaaacatttccctattgtttgtttatttaattgcttttattgtgttgttattttatatcatgttgcaatgaatgattctctttatagcaggtttcttcttttgaaaaatttgctttggttgattctcagggaattgaatcaaaggatatatgactgtaagacctgtcacccttaaaaaggactatgagggcttgctgaggaggggaaaacaaggaagcaagtctctcctaccatggcccaggggactgtgaggacagaaggcttgtgggtttgagggaggactgtcttgcagaggatgatagggtaaaatagaatgaaggatgatttttataaatggttatgcgccttaggatgactacatatttagtcccttataagagaaattgagtagttggtaaaacaacagataataattattaaatgaggaaagagagaaaccacaggtgcaaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccacagttcctgaggaaagaagcaaacaggatggtgtttaagtaacaaagttctgcccttgggtgtgttgtttgcggataatcacagggcatgttagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaaccatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttgcagaccaaaataatctccttaaatatcacttttgagatcagctggggtaaacgacagcaacacaatgacaaatcattaaactattttagagattatgaaattaaaatactcagattaaaattttcctatcacagaattaaggtactggaaaatatgtttaagtttttattaatcacattgctataggtttagatattttgtacaactgaaataaaatcacacactggcagctacatttttgaaagttaaaaacatggtcacgaatatatcttattttaaaatcagttaatataccttaatggtatttaatgccaaattcaaagtgaattgatcaagccctcagtggccaggtcatgggtgtgatttttactctgaaagaattacatatttctttctttttggttgagcttttgttatttaaatacatttgatgagaggatattgaaataattaaatagcactgaaaaaaaaaaagctttaaattatttacaatcccctaatggaaattttcactaatgagatatcataatgaatgtgaattttatttctgaaatctctaataaatcagtcttctccctggttttcccagctcagcgcccattacgtttctgttctctttcccttagtggcattatttgtatcactgtgcatcaggaaagctggctacggcagcatcaatcgggcagacacagggtggccacggccactagcggcaaggcggctgccccaagagcgcggtggcatggccaccaaagccactcaatcgagaaagaccgcggctctgtctacagctcgcggtgccacggccttcttggcagaataaaaatgtagacaagtaataacagaggataatgaaagaacatactctttaaaatatttcctatttttttcacagacccacggtcattaaaaaatgcaattatttactttttttcatttaaacacatttctttgagattgagcttttgggaataaccacctttccaccattacaataagagataatttcacgtttagtctaatgtacaaattggatttttaaaaaatgagctctatctgtgaagcccttattcctatagaatgtgtctttttgagtttattacttattacagactctaaaaacaacattgctgctgattttcaagtaagctgcctcttctacatagcaaataggtacacttcacttttccctgatttttcttagggcgtgctattgatttttattgttgtctgacaaaataatttatcaaacaaaagggagaaagactaaaaaatgtatttttccacttttctgtatcatgcataatcagcaacaaccaatacaatatttggcaagagtgaacaaaaataaatttacttttgctccttagaaatacaagggttcctttttagttacactttttttttttactttgtgtcattcagtttagagcaatttaatctttttttctccaaatccatttttgaagctgagtttaacttttgcaacccatggcaaatcttaaatgccctcatttaccaatctttaccaaactcctatttaagcctctaaaagtcaatactggccatcagacccaaatttcagaagacaatagtgaaaaattacttacgtttaatctccagtcgtgtcccttggccgaaggtgatccacagtgttaacttaattactttccccttaacaaaaatctcttttcgctgttaatatcactaacctgaccgatgcagagaaaatcttgcaattgagatgcctcacttaactggctagcgcttggctgttccttaagatgaactaattttctatcccttactcatctgactttttgaaagaatctggtactctttggaattgacctgagctaatatctcaaacacaaaaacgctccaaatttaaaaccttataagaaaaagcattaggaaagtgcacttacgtttgatctccaccttggtccctccgccgaaagtgagccacagtgagggatctcaccctttcccctcaacaaaaacctctcttgaagccaatcatatgagataggctgcttgttcagagaaaaatctagctatttcttccccatttcccccatgaatcctattctcctctcaaacccaatgattcgtctatttgctcagctttttaagttcattttctggtgtcctgctatttacttctgggtcaccaggtttattcaaccaaaatatcacaaaacttgcacaaatgatacaatggcactaaaatctcacgaataattgagacagatgtacttacgtttgatatccactttggtcccagggccgaaagtgaatcacagtgattcgtcttaacttttccctttacaaaaacctccctgaaagctcagcaagcctctttcccccaatgaagttattttgatttagaaatcttaaaaattagccacaagctagcgtcctgtggaacaatttcccctcctctgtacctaacctgggaatgaagtttgttagatccctggcatccgactaatgaaaatccacacaaaggaacacaaagtaaactaattagcaacagtgaagaatcagtggaaaaaagtacttacgtttgatctccagcttggtcccctggccaaaagtgtacacacaatggttcctcttaacttccctcctatacaaaaactccctttctgacaattgaccaaggctctgtccagaacatgttatgttccccaggacatttctgaagctattacttagacaagttattctcacccaatgactgaatcttgcttgctcttcaaagaaaatgtgcaatcaattctcgagtttgactacagacttatctttatcttttccctgaaggatatcagaggctgattgcagagtcaccttatagatcacttcatagacacagggaacagaagacacagacaactgaggaagcaaagtttaaattctactcacgtttgatttccaccttggtcccttggccgaacgtccaccacagtgagagctctccattgtcttgctgaacaaaaacccttctcaccaaaggggaacagagtcctgggtcagctgctgaagctcaactcccttttcgagcaggtgtggaaaccctgaggcttctctgacatagcatgtgtttattttcttaggtgagacctaaaatccaagaagagaatatatttacgtctatggcctgatggttcctttctttagcaacttgccacatctggactgcttattatttatttattttttagaaagtagactgaatgttaattacaaagaaaaacaagcaattaaaaaaaatggccagtttttttgtactttcttttggggtgggctgggggggcttttgcaaaggataaacttcatttagtgtaattatggaaatcatcagcttctcaatgagtaataattacaggttgtcttactattttatcttctcctttgctgcaatgttatttaaaaaaaggtagactaaatatatatcaacttaaggctcataactttgaaatgcattttgaaatgtagctccagatggtatacgaaaccaaagtgaagactaatagagtagaaaagtagactttacttggttggtttgtctgttttcacagcacaggaagagctcagctcttactgagctggaccaggcgcatgccatctttggagctgccatggagtcccagtgttccatagtgtttccatagtaatctcatcaacaacactgaagaccttttcagtattttcttttgagtccagctccatttttgcagccttgtatctctcttaaccttccatctccaccccttccatacattactcccacctccctacactccttagagtttttctatggcctccagctttcacaagcactccctctgcttgggaacatctttgtccacctgggttagcttgtgaactgctaattgtctttcaaaattcaactgaagagagaccttctctcagattagccctgagcaggtgacctgaatttacagagtacagagacaggtcactgggcctagagtacctaattattttttattttatttatttattttttttgagacggagtctcgctctgtcgcccaggctggagtgcagtggtgcgatcttggctcactgcaagctccgcctcccgggttcacaccattctcctgcctcagcctcccgactagctgggactaaaggcgcccgccaccacgcctcgctaattttttgtatttttagtagagacggggtttcaccgtgttagccaggatggtctcgatctcctgacctcgtgatccgcccacctcggcctcccaaagtgctgggattacaggcgtgagccaccgcgcccagccgagtgcctgtttatttttacctgctttcagattctcttctacccttctaaattataagctgtttgatgttttatttgccctgtatttgggaggctccgtccagtatctttacttagcaaatgcttaacaaacattttcagaataaataaaaaaaaatacctaattgaaagtcaataatagatcagagatgctatcatagaccaaagactaatactgactgccacaacagtaacttttacaacagaaatcataactacaattctaaagattaggggtaggtttatttgattctgtcactggcagctttgctagttgccttgaatagcagaattagcatttggtctcaccagaagatgaggaaggagagggatcaagttagaggtggagagttaacattggcaagtgaaatttaatgtgcaaaatagctgaccaagggcatagtccttttttaaaggggacacaaagtgattttctctgcagacatacacgcaataccaatcataaagggtgacatttattgagcacttactaagtgccagacattgtacatggatcatcacatttaattattcccaagactctatgaactaggaactaatattatcccctactttgtaggtgcaaaaacttgagggcagagaggtcaaggaactggcttatggcagtaagtggcagagctgtgacctaaactcagatcccatgtttttaactgaactatatgcagattatactccaggagtaaagtcactcaacggaagcaacaagcgtgacagggaatgctgggatgggggaaggtaaaaggaactccttagactgggataagtgtgtacagacgtatgtataagactacacatggaaatattgtttaaagagtgaaaaataactaaaatcctcattaataggagtttggttaaactgtgctagagctttacaatgtagcacaaagcagacattaaggggaagacgtagacttctatatagttacgtggaaggtgtttgtgaaaatgcaggtcactgaagagtatgtgtggtgagatatcatgatcccatctacattgaatatatatgtatataaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggtgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggccaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttatttatttatttgggtttgggtaaaacttaaccatatgtttaacaggacctggactttgatttaagcaaacttagggtaaagacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacaccacgttttctttatccaatcatctgttgatggacacttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacttggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaattttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggttcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataatgagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagcgaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagcggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagtgtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactattttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttgtctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttacgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctcatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactacccaattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataaaaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcatcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctgttccttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacaaagatgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtcttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgagaaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaaagaattgaagcctgtgacaagttgatgaaaggggtagaaaaaagaataaaaccccaaaacacagcactataaatggaaaggggaaaatcattgcagagcctatgattataaaaatacaaaaggtggatattctgagtatttttatggcaactagcttgacagaagtaacaataactttgtattataaatttacccagaacgaaatttccaattttatatctgcctgactggtgtcttgataccttatcaaaattacacaaattttcaagagattcaaaaagaataaatactcccaaacttatcatatgagatcaccatatactccagtccaaaaacaaacaaggacgtaacaaacggagaaattaaatgctggtatctcttgtgaacataaacacaaatattctgaaaaatagggaaagaaggaaaatataatcatttttatacctatatgtttgtgaacacacatggttaagtgtattacagtttttatgctaagaacacttgatatgtaattacaagttctaaaaaattgatatgaaacggaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcggagctgagattttctctcagatattctggctcatacaattttcagtacactacagatagaagatgcaaagacaacattacccaattggtcttgcacttactttgttcactgttaactaagtttactgaaaaaaaattacaataaaatacactgtcaaagaactgtcacaaataaatacatctgcagaaccacctccaaaatccagacatagaacatttctataactcccaaaagttttgacctactcttttggaatccacttgctttccaccacacagatcagggaattcttgatctgcttattgtcagtgcagattccaatttctttttaagggtttcatataaatgaaatatagcatgtgctcttttgcatctggtgaattttgtgcagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaattcctaggcgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaaggtatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccagaccttcacaataatttccactcagatcatttggtggcctccttgccttgttctccttatgggacttcattctgagggcatgtgacatcacagagggagcagtgcacttgggtacagaaatatggcttaggggattgtctggccttagaggtggctgcaatggaatatacattttcaaggaagttccctgttaaagctgataaattgttagttaaggcaaggtgcaggggcttatgcccgttatcctagatgtttgcaaagtcaaggatggaggacagctgaaagccaggagtccaagaccagcctcgaaaaaataaggagatccccctgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgacaaccctctccccatttcccctgcttcaagttcctggcaacctccattcaagttctgtctctatgacagtgactactctgaagcaggttcactgtgccctggttaccaacttatcagagtccagggagacagaacaatcatacacaacaagttacaagaatctggtgtagtatttataggtggccaacaagggactgcagaagcctaggatgtattgtgggtctgtcccctgaggcacaggcatgtgggtctgatggaatcttgactgtgtgtaccccagttggaccacaactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacattctacagttgttcttgagaagtgtaagaaagagagtggggagaactaactgagtcgagaaccattagaggactgtactggagtcacccccaacccaaacacccccgttagaaagccattccattttatatgcctactaataaccctgaactggtggcagaggtgtgtcttgtttgactgatgaagcccctcgacgaacacaatgtcaaagcaacatcatagagccagagccagaatagatttcactgggccaatgaaaactactaccagaggcaggatgatcaggcccacctgaagcagttatgtagcccaggatccaatgatccacagaagaagttgctaaaggggtgaaagaagaatccttcaggtgggaccattttcttcaattacgagcctgtttccagatctcctctcttgaatttctaggatacctgaggtgtttgtccaggtacaacagaaagtgttggaaattgtatacaatcctcccagttgggattttaaaaaagtctagagcaacactgttatctaaaacatccatcccgatggagttaagggatgtctgctgggctaccaaggcagtggctatggaggaggagccatatctgccatggtcagggacacatttcttatcatttctcttttttacatgagcactgactcctatacatagtaccaaaaatatcacaaaagacataaacccatagtctgttataccttctggcaggtccctagtaagtctgaggtacagctttgggctgcaggctcaatggttcacctaattccaaggagtaatatccagagacaagcccagcatgcccaacatgcagaatctcaccatcccacagttatccagagatggcatcacacatcctgcattttgttcactcccagaccattcacagagaaatatgtagcccttgggtgcatacagccccctttctcccattttattgtttaatcacccagtcatggttatgcaggtattggtgtgttcattagccaagtctcactgatggcagagttgaaggagcaaagttttgctcagacaatattgttcatagacagagggtagcattagtcctctccttgtttttgtctttgccattggggcatttcttatctatgcaatcaaagaaatatggtacatcaaaatatcagtccaccaatgttttttttagttgtggtcatgacatttgccacagagtcaatttagttaaatggggggcctccagttttctcccatgtggtaggtatcacatcctcagttggtaggccagtgcccgggtcctgttgatgtacaccatgatatcagtaatgttggtgtcatttgccttcagtagaatgaaaggaaacctctagttagtgacagaacgaggtcaagaatggcagattcagtattttgaaagattacactcggtgacttgcaagaagctaacaaagatgttatgcttctaggcctttgctgcctcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaaaaatccattgcctttgtcacttgacccagacatttcagtcctgattgtccactgcaggaagggagattatgccctgtaaaaacttgacatatttcataatatcaccaatactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaagggtctgcctggtctaccttcgtttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctattgtcatgttgcttgggcagtgaaagatgctccttggtcagtgtgaagtgtcattgggtatccaaaaatatgatgtaagttcctttcaagggtgaccttggtagtcccggcatccaattgagcatcgtatctctttttcctgcaggtggaaagctgtggccatagtcctttcctccacaccagggattctttaaaagtccagtctctcagttgccattttcctgaacagatgttgaggctgttggcaatggcccatgatttagtgggaatgtggcatggtacgatgttggaacagcctgcatggccattaccactgaatgtagtttgacccactgggttgaaatcccatgctaagtttcagttaaaaaagtggccatccattggctgaatggtggccacacctggtggacctgtcagtttgcgttttcctcagccatcagtgactcctgctatatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacctgactctgttgagattgttactgccttgaaagccaggcaggcgcttctcaactctgtgattcttcccaggaaatacgtgagaacttccatctgggttcatatctcaaacacaacccaccagtctctcacttgctgccctctgctcaaaatcttcacattgtaatttttcatggggtaaaaagttagcttatatattatcttgtattcattcaaattctgtttaaataacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttggcttctccctgaaaaaagtaggataaaatacagtgcttgctgctgttctggtcaagggtcggccttacaaaaagtggaggggggaggtggaggaggggagggaaactgatttaatatcaccagatcttatcaatgtacatgtactctggtaactgctaaaccaaatcaaaagaatgtgttagttttgtgttgccagtaatcagtctcaattaggtgcctgttatgcagaatgaatttagttgatgaatgaacatagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtggtgcctgaggtgtagccaagaaatttatggtcatgagccctcagctgcaccaagtcctctgagttctccaacatcttggtctttaggcatctaagagaatccacagtgcctgctctccacagaaacagcacatctgggcagctaggccacagcaagtgggggggtttgtgttcaagactataccattgtgggaggataatgtgtactttgctggcagcaataaaccccaacatcctcagcatccatcctcctgatttcagcatgaaatctgtccccaacccactgccactgaacctgtctgggactccagggtcgtgattggaaaccaaatagattgggagccaaggaggctggcctgtcttctgtaggtaccagttgaaatagatgtatccattactgtgaagggggctgtgactagacctgcaggagatggaggctggctctccaggggtgatgggcagggagagtggaggttgggtcatcacagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacagatttaaaaagaaccaatatttacatatccttgctccttctggaatcttcctcactctcacagatctagacatcacatgccccatcctggaggacaagacacatctaacacgaggacaggacacacatgggaggtggcggggtccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaaggttagagtgagctttcgtctcagactcacaaggaaagtcctccctaggggacagtatgcaaatcccctggtgggtgcagtggggtggaaagagccaaggagaaggtgggggcgtctcttgtgagcaaaatgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttattttattttattttatctaaggtaaaacacacagtgcaaagggtgcaactcttaagggtgcaaatgaatgtcaagatccagatcatttcatatcatgatccacatagaaacgcagaaggtttccaattctctcgctgctttcattatgcaccttcccagtcaaaaactgctgctcaaaacacaatcaatgtaaatgatattctgacatataattgttttagtcctggacttaatctttatatcaggtaaagtaaacattttttgtagcttctttctaacttttttcattttttgaggccttggttccttcttgtcaatttgagttgctgtctgctgtcattctctgttattctgaagaattttctcttgaatctcttacaaggcatatatgctattaatgaattaatctttgtgtatgaaggaatatttctaccttgcttttatatttaaacgattgtttttctggatatagaatttgtggctgagaatttgtggctcagtatttaaaaatatcattccactgtcttctcacctccatttgtaatggtgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtctcatcactgtaaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaggtcatttacctaagtgaactaatgcagaaacaaaaaaccaaataccacgtgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgcgtcatgttaaattgctgttgagtctatctaatacatttttcaattgagttgtacctttcatttttcggattcccagtaggtctgttttcatagttttgtctctgtttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgaacagaaattcagcttataaattcctgggaattcctaataggaaaattgatgaaaaaatggtttttcttaggcccccacacctgcctctgcctgggacctgactttgtctctgagccggcggaatctatgatgaggttttgagttgggcagtgaaatcatggcagggcaggctgtgctctgggtgctgtggaggacaaggggacactcctgcagggttagtgatgctgggagttcaaggggagactcagcatggagctgcctgttgagtcaccccagcaatcctgtctggacagtgatcatctcacaagtgtacttggatgccagtggatggcccaaatgtgggttcaggttggacaaggacaaagctttagggatgaacatatggggctcatttgatagtctgaagtttcagcacaagcgtaatgaatcatatgggaaaagaaaggagtcacaaggttgtgacttttcatttgatattaaaatatattccctctgctcatttttccctacagaatgtaactactgttacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccacgggccactgatctggtgggaacctgcagtcatttcactttctcatacccagatgagaggacaccttgatctgtgttcatctgatgatctgatgaactctaaaaactggaccatattctgaaggtctagttcacacttcttttctgtgctagagggactctactcacatgtattgtacactctgcataggacagtctgtgatacatacaagtttttttctgctaaatactcatcaatcttgtcatttatgcatcttctatagttgttacctgacctatggctatggggtcttccaaaagaatgggccagaggtggagctgtgaaactgtagctgaataagaagtgtaagtgtcaagatagggtaaagaagtgttgataataataatatttcaaattagtctgggctcttggctgtgattactggtaagtgggaaagagtctaggtttgttttttttaagttttattttaattgataaagtagccagggtaaagtgcacaaatcttcaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcctgtcttgaacttcacataaatagcattaagtgtatttttctctttttagccttggtattgctccttacaatgtttgaggccttcatttcttccagtggactcaaggtcctgtctgatgtcatttcctgggattctgaaggattttctctcaaatgtcttataagacatagctgctatgaatgaatgtacttttttatcaaagaaaatttttttttgctttttctttagatgtgaaggtattttcactggatatagaattcctagtgacttttttctcctttcagcatctaagtatgtcatttcactgcttctaatctctattggtcctaatgaaaacttagccaataacaatatgttgtttctgtgtattggttgggagatgatgtttgacagtgatcagtttgtgaagcagaggcttgtgtcacaatactttccacagtactacatttaaaaatggcgaatggcctttcattcttgatgcagtgaagattttctgtctttcaacattttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctccttttttttaaacattttatttagactcaataagttctattcctttattttcaagttaactgattattctgccatctcaaattgctattagacctagctaatacgtatttaaattggattattttacttttcatttctagagttccaatttggtcattttttatattttccatatcttttcttgaggccctacttgccaaatcttcttaatattttcttttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctagtttttttcccaggagctgttaaactgacaattttacatttttgataatacagtacctctctttagattatgggttttttaattttaattttaattttttagaaatagggtcttactctttcacccaggctggagtatggtggtgtgatcatagcttgctgcagcctcaacctcttggggtccagtggttctccagcttcatccacctgagtagctgggactataggggcatgccattactctctgctatttttttttttttaaatagtaagatattttgcccacccagcctggtctcgaactcctggcatccagtgatccttctgcctcagcctcccaaagtactgggattacaggcttgagccaccacgtcaggcctggaatttgttttgtttttctgatcattttttaattttcttcttagttacttgggtgaacttactgatagtacctgacttatgatgcttggagttataactttttgactttcagatggtatgaatgtgatatgcattcaagtagaaatagaaattctagtatttatacaactattctattttctctttcaatatagtattcaataaatgacatgaggcattcaacactttattggaagataagctttgtgtaagataatgtcgcccaagtgtaagctaatgtaagtgttttcagcacatttaggataggataggctgagctataatgttaagtggattagatgtattaaatgcatgttcattgcatgatattgaaaaatctatctcacgtggtgtttgaccactgatatcactgcttccttttattcttaatattaatatttagtttgaatttataggaactgcacatgtatctgcatagtgaagtggtcaccaatgatttgagacgttttgcttaaatatctagaggttataaatctatcttctgtcaacccatctgtgtgtagtttaaaaagcaaactgcatgcaaaatgcagctagttcttgaatccttctggttttactttgcaccggaaactccttgttctcatcactcatatctatatcttctaggtcactaggaatgtgtgcagagattatttcagcaatatgggtctatctcatccaggaatctgctatttactatcagcagatgtactacttgcctcaaacaggtcatcatcttggacttgtaaagctgtgagatttttctgttcatttcctatggagttctgcatgtttagctggaaacactgaataattttttttccactccttggctttactcaagtccacccactttggcagcaagctgctagttttttttgctacgctcatattggtaaaacttcagttctgtaattcatgctgattgagctgggggtagaaggctgctgtcacaggcaaaaggctacagacattttctgtccttactcaaagcactggtactttttttttctataaagaatatgcatccttaattattttatacttcaccaattttcagagtgctgaaatagttttgatacttcagctttatatttaaatgtgtgtttgttgtttatttttgcaccgaagatttattaaactctttgtgatgccataaacagagatgccttctaaaatgcatttagttgaacataatagccacggtgaaatggtacgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggaggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggtggctggagactgtgtcaacacaatttctccggtggtatctgaaattggaaataaaacagaaatgcactcatgtaatcaagatcaaaccaactgtctttgagtagagccaaaattgttgatatactttgaattttaattatatttcttgctgagcagaggtggcaagagttttcactaatgtgcaaaaccacctcatgttcccctcacctgggagccagagtagcaggaggaagagaagctgagctggggcttccatggttccctctgggtcctaactgagcagttcctccccagggctctgacacaggcattgatatgggctctggaaggtagggcagctgggagggacatgcaaagcagctgggtgggagctgagcttccagctgcagagaccacctgcttcttcctctctgcactgagcatcctgcgccaccctggttgtcaggccagaaaagtctgttggctcagtctgagtgtagaacttctcccttgtgctcagagaatttcattcctatgtctttcttctcctcaatcacctaaattcacccagatgatgtttggcacaagcctgttaagaacaatataaaaggctgtgttttcatttctctcttcctatcctcaatatgcccagtcatctccctaagtgcattattggatcgatggaaatgaggagtctgttagaacttaatcttccagatacacctttcatttgcttgttagtaatgttttctgagggtcctgaaactttccattaacccagacacataccctctttgagttaaaaagttaaaacttctgtttacagtcacatgtcctggcagccctgacatagatgctccatggcttgccgattgcttgaaattgaccaactaacttaacttccctgtgtctcagtttccatatctgtgtaactgtgacaatactggtgcctaccttacagtgctgtagacagtttaaagaaaataagataaaacatttacagtagtactcaggacattatgtatgcggcaattatttttgtttttattgattaaatatttagcactacagtcatcatcattatcataaatatacttacttggcacagaaaagagtcttcaatctaatccaagaatgttttatcaacagtcaaattaaattctagggctttttcttcactaactgtacacaactcttaaaatcctaatgatttggtcttaatctgtgctaaaatgctcagaccttcaatcattcccgcccatctctgtctaacgcattaattctcatcatccattatcaaaatgttatcctatgaaagtttcccatgtcctgctgctttccttctttcttacataatctttagtctaccttgttatcttttgtcttatttttgccccaggactgacaataaggaaaagctaccatcattacttgtggacttgctccagtataattttgtcaggcttgttatcttggaagtgaggactatgtcttgcaaagaaacatattcattgggtcaatgtgttatcaaataaaagattttatctacttatcatccaataattaatttagactgacttgaacagattttttttaaggacgaaaaggagaagatgatataagaggaaaatacaatacaatatcaaatgctagctattatgactcttgcttcatggatttttacatatatattagacacatggtgggtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtaggagaggttcgtcctgtgatgatatggctgttgctctggttgctgttgttaggaaatacagtgggagtgaaagcaagtagaagattgacaagctctgctcttcctcatactcacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagggaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcgagaccatcccggctaacaaggtgaaacaccgtctctactaaaaatacaaaaaattagctgggcgtgctggcgggcacctgtagtcccagctacttgggaggctgaggcaggagaatggcatgaacccgggaggcagagcttgcagtgagcgagatcgcgccactgcactccagcctgggcgacagagcgagactctgtctcaaaaataaataaataaataaataaataaataaataaatataaaaacattcaaagctactgattttgttgttgttgttgttgagatggagtcttgctctgtcacccaggctggagtgcagttgcatgatcttggctcactccgtttcccaggttcaagcgattctcctccctcagcctcccaagcagctgggattacaggtgtgtgccatcacacctggctaaattttgtatttttagtagggacggagttttgccgtgttggtcaggctggtctcgaattcctgacctctggtgatctgcgcgcctcggtctcccaaagttctgggattgcaaacatgagccactgccccggccctactgatgtattactattattcatcttcttgaatacagcaagtggtaaggtgcaaatccacaatttaaacttgagatttctactcctatgtgaattataccagtgaggaacagaaaaattctgtattgtttgggagatgatgtttgacagtgatcagtttgtgaagcagaggattatgtcacaatacgttccacggtattacatataaaaataacgaatggccttaaacccagaagagtctgcatttctcatgagccatactaccaccaagaaagaattgaattgaaactcgtgactacttgatgaagggtgtataggaagagggaaagaaaaaggacacaaaacataatattgtaaatggaaatgagaaagtcattacacagcctattagagtaaaaaaaataaagagaggctaaatgagtaactttttggcaactaacttgacaaaagtggtgcaatcttcacctcctgggttcaagcaattcttgtgactcagcctcccaagtagctgggattagaggcgtgtaccaccacttatggcccttttttttttgcatttttagtagagacatggtttcaccatgttggccaggctggtcttgaactcctgacctcaaacgatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagttgggtggccaacagtgagccccaaaggcctgattgggaccacagaacaatgtgactctggcttcttacggccaacagaacaggagaattcttacatccaagtgtcctgccttaaacaattgcacaaacacaattagcagggagccaaagccaaaactgcaaagcaaacacatatatcagggcagaaaataagataaaatggctgatggataaataaaatggcattagaggagaaatgactaagagaaggaccaaggaggatgtagtcaggtgtgctatggaggacttcaaatggactatcgagtcaaaggccttattccctggatcatccaatataggtcaggtgggcagaggggacacttacaggtgtgcaggagccaaaatggtgccaagcagtctctaacgtggggcctgcgtgaaaatctctccaggctccccagcttgggtgggttgggctcctacggggaactggagcacggagcggctggcctgcatgaagcagtggctctgtggccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctctcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcagacgctgcctctcaccatctctagagttgagtggctggcttaatcctgatgcaaggcaagttcttggatttgctcgggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttcccggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgcaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagcccagaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacaatttgtgaacaatgtcatcacaaagtgattatttatgaacatttgctcagaaaagtagaaaataaaacaatgtcttctgagctaacaatactataataaagacgttagttatttaactatagtaaatacagagaatataagattgtctatcttaaccatacttgagagtgcagagaagtggcattaagtatattcacatgttctgccattattactgacataatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaactcaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcatcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacagtagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcatttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttggtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagcttgtcttcagcctacacatatcaactgtctgaggacaaggctgaacagcagtgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgcgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcagcacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagagtcttcactgaatccctggcatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatggtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacggaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgagatcaaactatgtactatagatacacaaagatgataccgtgttttctcgatgcatgcagcagtcacagatccacaattatcaagagcgacaggtctctatagtactcagacactaaatgggttgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcatcctgacccaggcaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagtgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcgtagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtagaacttttgcatttctaactccaggcatcatcttgaaagtggagaaagcagaccttaacctgcccatgtcttgatctttaatttcccattctccagaactgtaagaaaataaatttctgttccttatgaattacatagtgacaatgaatctgttatagcagcttgaaatagaacaagagagacagcgcacaatcagtgaggacacgatgaggtgtatacataccccagcttcctcatctctcaggtggaatagcccagaggaacttagtccatgtttccacatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaaattgttaatcttttgtaagaggggtatttctcatctgaattctgataatttctttttctttgacatgtaggaatattcaggaggcacttaatttttttttttttttttaccaatctgttttacattcaatttgtgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttttctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatgtcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccgttttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggagggaaaaccactcagggtgcaaaatattgtctgaagaatgcaattgaaatagaccctattatcccatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctccagcttcctgttgactaaattatcttccttacccctctctaattcctgttttccacatttcttccctgctatataaacgcctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttcccttttaataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgtaatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcggcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgatatcaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgctagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctgggcacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgccctatacttggaacatttctgtgattttaacattgttcctttctaaaaaaaatcaaaaataaaatttattgacatgatgctatatatacatgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaatgtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtttagatgtgcctcattatactctcctccctttggagttcagacacaactgaccagcattatcattacaacagagatctctggactgatgaaacagatactttttagcaataagataccatactccaatgtgacagataataggccctggagaaaataaaaatattttatcctaaaaatatttctttgacatattctgaagtggccctgcaaagctacctgttgtgggggaaaattgcattctatagagaatctcctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccaatcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataacctgtaaattgattgagacctgcctcagatagtgttttgcttacactaggtcacaaaattttaaaatgcctaaaccgcagcagcccggcattcctccaggacctcctcccccgggatcttgcttcaagtgctggaaatctggccactggaccgaggaatgcccacagcctgggattcctcctaagccgtgtcccatctgtgcaggaccccactggaaattggactgtccaactctcctggcagccactcccagagccactggaactctggcccaaggctctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccgccataactgttgtgggtattgacggccaggcttctaaatctcttaaaactccccaactctgttgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcctgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcatctcatgacttagcaaccaatgttatccatagattccaagcattgtatgaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacaactcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagtcaccttctttactatccccttgtatccctcctctcagcctctttttgcctttacttggactgaccgtgacacccaccaatcccaacaactcacctggactgttctgccccaaggcttcaggaacagcccacactactttggccaggccctttctcatgatctgctttcttttcacctgtctgcctcccaccttattcaatattttgatgatcttcttctttgcagtccctcttaccaatcttcccagcaggacactaccctgcttcttcaacatctctatttaaaggggtaccgagtatccccctccaaggcacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaaaaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccatgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcatcttttattgaaaccccaacagtaactattggccatgggcacgatttcaacccagcttctcagttagtaaccaacacaagtcctgaaccacgtgactgcatttccctaatacacataggatcttcctcctttcctcgtatttctattcttcgaattcaaaatccagaccacccaatcaattttcaccaggtaagctggatatgctgtcatgtcccacatctctattattgaaactgctgcacttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggtcctccttaaggctgctctcctgctggccaagcctggagtcattcattgtaaaggacaccagaaacctactcatcttattgcaaaaggaaatgcctatgccgacaggacagcaaaagaaatagccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcatggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagacataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgacttcaagatgctacagggtacagtccatttcaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaatgatcagttcttgttaagagtctgagccctcaaactctacagcctcgatggactggaccctacctagtcatctatagcaccccaactgctgtccatctgcaggaccctccccattgggttcaccattccagaataaagctgtgtccattggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgctggtttacactgtttctccaaaccatcacagctgatatctcctggccctattgccaaaccaccactcttgacttcctcttggagtggatagatgatctttgctggcagggcacactccaatattttcaccatgatgaagtcctattctttatttttatactcactcttattctcattcccattcttatgccaccctctccctctccccaactatctccactacactatcagtctcactcactctctccaagccatttctaatccctccttagcgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccagcaagacctccccagacatttcacatcagaaagctgctgcccttcttcgcacttacttaaaaaacctttctccttatatcaactctactccccccatatttagacccctcacaacacaagctgctattcctgtggctgctcctttatgtatctctcggcaaagacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgatggctgccgcgctagctggatccctaggagtctgggtacaatacacctcttttagtactccttctcatcttttcactttgcagctccggtattgccttgcacaaggtctcttcttcctctgtggattctctacctacatgtgtctatctgctaattggacaggcacatgcacactagttttcctaagtccctagattcaatttgcaaatgggaccaaacagcttcctgttcccctcatgaaaccgacacgataaaaaagtgttattccactaattcccttacttgtcagtttaggaatttctgcctccactattgctctcggaactggaatagcaggcatttcaacctctgtcacaaccttccttagcctttctaatgacttctctgctagcatcacagacatatcacaaactttatcagtcgtccaggcccaggttgaatctttagctgtggttgtcctccaaaactgccaaggcctcgacttactgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccagaccatcaccaatcattctatatggcaaatgctccttataacaaccccacaataccaccctttacccgaaaatctttcttcagtttaatatcttctacactatgttcccatgccacccctaatcccactcgaagcagccctgagaaacaatgcccattctctctccataccaccaccaaaaatttttgccaccccaacacttcaccagtattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccaccctaactgatcaattaaccttgtgacattccttctcctggaaaatgaatctcaggagctcccccacaaagcaccttgtgacccctgaccctgcccacaagagaacaaccccctttaactgtaattttccactaccctacccaaatcctataaaactgccccaccactatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccagcagatccactttaaacataggcaaaatgagccctaggaagataaaactaaagataaagagaggatgttaaataatgttagggacaaaaggctacaaaaatgagaagatagatggatataatgcattgctaaatcatgtgtgatagttgtatcaaagttgtaatactgttttgttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggtaaaattaaaatgaaattgtgaagatgttcaagtaacccaaaagaaggcagcaaaaagaaaacagagaagcaaaaaaagatatagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccaggggcagaaaggtacattacataatgaagaaagtcattttggaaagaagacagagcagttctaagtgcgtagacaccaagcaacagagcgatatagtgcatgtggcagaaactaacaaaacaattgcacacagagacttcaaaaacccctttttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacccccaaattttcaaatatatgggaactatacaatattgttctttccaaagaaccagcctttggcttgcctggtgttcagtgtcactttttctgtttgcagttttattgatttctgccctaatatttattatttattttgctcatgttctacttcagatataaattgctcctctttatgtagtttcataaggtggaagctgagattattggttttatcccttttattttctgaaaaatactcatatgcatatgtttatctacgtgcatacacatgcataaatatgtgcagatgcatatgcatacacgtggttttaataccataaattaccctgtaagtgctgctgaatacctatgcgtattttcttttctctgagctcaaactccactcacttgcaaacctgcccacttaatctgcatgttcattggtgtctcaatctagaattgagcaaaaataacaaactcctttcattttatctcaactttcttgaccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagtttatgccaggatccactttgcccagataagcatctcttctgcttctcacagcccaattcgagtcattactttgctaaaaaataaatatgaccatgggggtactttggttaaaaaaattcccagaatgtcctgctgtacttacaaagcatttgctccccaaacagaaaatgaaggccttattaatttcacatcagtcacatgtggtgatctttaagacactgagagaaaatggctctgacctgccccctcacgaactttctcttttttacctcggttggttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggtccagcatagttgctcaattaacactttattgaatgaatgaataatgaaaagttagtaagaaactctccaagacataatcaacactcataacctatacacgttgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtgcagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagttcccatggatagagagctgactgtacagctccttataattctgagggtcagctctgtggttcttccattctgggctggctggactgatctctgctgagtccgctcttgtgtctgcagttaccctgtggttcatttgcgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtgtgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactatttttaattttcagaactggttgtatttattatttctgtgttaggtgctcttagtcacttatggcaagagtgagttaatagagacaacatacagagtagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctgtaaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagcctgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagttggcacatggctttgtcgggtcctggccattggatttcacaagactgtgccacagtgtagattgggcttcattctcacctgtgagtcccctgagaacatagatactttagagctctttcaggtagttgcagagctcattccttagcatttctatgactcagggcttcaatttctaactggctcttggctcaaggctgctcttaggtccaagaggctgtggacaattccctgccatgtgatgctcacacaggcaatgcccacatggctggttgcttgttcatggtcagcagaaggtttcagagagtgtctctttccagtctgctatgacagaggcttatagaatacaatcattggaaagacatctcataacctatgacatatcatatggattagaagcaagtctaggttccgcttgctctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatccgcaaaatttatatttaatagtaggaaaatgatttattaaggagtctattaaacaagactcagggaaatgatgtcaacacccaattgctgctgcccactgctagactatgtgagacaattttcatgaacaatagaacagatactgcatgctagacacttctgtgagcaccactggcctgctacctctagaaatgtttgcagaacaagggcaattgctatgagtctcaaaatatatatttttttattatactttaagttctagggtacaagtgcacaacgtgcaggcttgatacatagggatatatgtgccatgttggtttgctgcacccatcaactcatcatttacattaggtatttctcctaatgctatccctcccactgcccccgaccccatgacaggccccagtgtgtgatgttcctcaccctgtgtccaaatgttctcgttgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacattttcttaatccattatatcattgatggacatttgggttggttccaagtcttgctattgtgaatagtggcatgataaacatatgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcatctattgtttcctgacttcttaatgattgctattctaactgacgtgagatgatatctcactgtggttttgatttgcatttctcttatgaccagtgatgatgagcatttttcatgtgtctgttggctgcataaatgtcttcttttgagacgtgtctgttcacatcctttgcccaatttttgagggggttgtttggtttttttcttgtaaatttgtttgagttctttgtagattctggatattagccctttgtcagataggtagattggaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgcctaggtgttcttctagggtttttatggttttagatctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgtgatacctccagctttgtttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttacttcgttgagcagtggcttgtagttctccttgaagaggtccttcacctcccttgtaagttggattcctaggtattttattcactttgacttaatctgtgaagtgtatttaaattctcattctagagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcactgttaactaagttcactgtaaaaaaaaaaaaaaagattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcctgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaataccaaggcgtgtagttgctgtgtttatcagtaagtgtttaatactctgtccgactttaccgaaagtggctataatattttatatgtccaccaataacttattatagctccacaccctccaaaatatttcaattttttttttaagatttcacctaattgtcactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatatttaggatggtaacatgatatataaagggagtgttggagtagtaataagtattttcaatacttattatattccataaagcaatatatcttcaatgaaatggcatttaactagacttagcatagtaaggttctcatctcaaccctagtattcagtattagcaaaagtttgaggaaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaagttccctgttaaacctcctggtaaactgatagttaagaccaggtgcggggacttatccccgttatcctagatgtttgcaagatcaagtagggagggtagcagaaatctaggagttcaagaccagcttggaaaacatagggagaccccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcaataatatccatctccagaactctttccatcttctagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtgaccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattattgagaagtgtaagaaagagagtggggaaaatcaagtgagtccaggaccatcagaggactggagtgaagtcgtcccccaacacagacatcctccgtagaaagctattccattttatacgcctaccaaccaccgtgaactggaggcacaggtgtgtcttgtcagacggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccgatggagttaagggatgtctgctgggttaccaaggcagtggctatggaggaggagcaatatctgccatggtcagggacaagttccttatcatttcactttttttcatgagcactgactcctatacatagtaccaaaaatatcataaaagacataaacctatcatctgttgtaccttctggtaggtccctagtaagtctgaggtacagctttgggcttcaggctctatgatttacctaattccaaggagcaatatccagagacaaccccagcatgcccaacatgcaggatctcactattccacagatatccagagatggcatcacatatcctgcattttggtcactcccaaaccgcttacagagaaagatgtagcccttgggtgcatacagccccccttttcccatttttcttcaatcactctgtcatggttatgctggtattggtgcgttcattagccaagtctcactgatagtagagttgcatgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttaattgtggtcatgacattcgccagaggcaattaagttaaacaggggtcctccagtttcctcccatgtggcaggtgtcagattctcactttgtgggccagtgcttgggtccttttgatgtacaccttagtattaggaatgttggtgtaatttacccttggtagaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcgtctctcacccatcccagggtctcaggtgtcccctacccatctacaagggttgggccgtgttggtgtaggaatgcggtctggctgtccttgctctgtgaacaatccattgcctttgtcacttgatccagatatttcagtcctgattgtccactccaggaagggagattctgccctgtaaaaactggacatatttcataatatcaccaacactaaagggaggataagatgtccctggcaccagaagagggcccctagctccgtgatatttcttagtcttgttatccatcactgtgggatcttgtagaaaggaagcacccagaggaaacataatcctcctattagagttagggggcctgtctggggcattgtaatggcctagattgcaaaccaccccagagcatgtattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatctttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcacgttgcttgggcagtgaaagatgctcctttgtgagtgagaagtctcatggagtatccaaaaatatgacataaattgcactcaagggttacctaggtagtcccagcatcaaattcagcatcatatttctttttcctgcaggtggaaagctgtggccatagtcctttccttcacactggggattctttaatagtccagtctctcagttgccattttcctgaacagatggcaaggctgttgacaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggatctgtcagttagcattttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatctaagtgagaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggctactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgatagggtatcaattcaattacctagggtttgtgtgtcagttttgcttgactaagaatatgttttctcctttctatagagacggctgcacctgtgcaggtgataagatcatgaactgcaccctttgccttacttttttgttgtaaataatttgcccgattcaatgccatattatggaagaatttcttaactgtgatgaaagcacttggaaaatcctcaaataatatttcatgcagaaatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccatgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagatagtgatattgttggtaatatccagagcggggagaggacaatagtactcccaatattgcgggaggtgtacacccctctttgtgttattgttcttaatatccagggggaaaacaggatgacgttactaccaatatcgtggggggtttacaccctcccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgcggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatggtattacttccaaaatcgtaaacacattgtgtgtacacccccctgtgatattgttcgtaatattcggggtgggggggagaggatgacgttactttaaatatcgtaaacacgttgtgtgtacacccccccaccccacgatattgttcataatatccagggagagagaggagatgatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagcaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggagtgcacgcctctgtgatattgttcataacatcttgggagagacaggaggaaattactcccaacatcgcggggcatgcacagccccctgtgatactgttcgcaatatccagcggggaataggatgacattactcccaatattgccggggatgttcaccccactgtaatatttttcttaatattcaggggggaaggatgatattaatcataacactgcggggggtgtacacccttctgtgatattgttcattgtatccagggatggttggagatgatattactttcaatatcgtaaacaccttgtgtgtacacccccctgtgatattgttcctaatatccagtgggggaaaggataatattactcccaacatctcgggaagtgtacacgtccctgtgatatttttcataatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggaggtgatgttagtttcaatatcgttgacaccttgtgtgtacacccgcctgtgatattgttcgtaatattcagagggggagaggatgataatactcccaatattgcggggagtgtacaccaccatgtgatattgttcataatatccagagaggggagaggatgatattatgcccaatatcgtggggggtgtgccccccctgtgatattcttggtaataatcggggggagatgacattacttccaatattgtggggaatgtacacccccttttgatattgtttgtaacatttggaggggagaggatgatattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggatgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggatgatcttactcctagtattgcaggtggcgtactccctgccatgatattgtttgtaatacacagggctgccaggatgatattactcccaatatcttggcattgtaccctggcccagcatgatgttgttgttcgtaatacccaggcagggagaggatgatataactcctaatatcacatgcagtgtaccccctctgtaatattgtttgtaataccctgtggtggagaagataatattattctccatatcaggggtgatttactcctcttttgtgatattgttcctagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctctctctctttgccttttgccatccacgtaagttgtgtcttgctactttttgccttctgccatggccgtgaggcctccccagccatatggaagtgtaacttaattaaacctcttttttttggtaaattgcccagtctcggatatgtctttattagaagcatgaaaatgggcaaatacagtcaattggcaccaggagagtggggcgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtggtctcagatgaagatgaggaacttgttgggagctggagcaaaggttattcttgttatgttttagcaaagagattggtgacattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccaatgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggccccaagccttggcagcttccacgtggtattgagcctgcaggtgcacagaagtcaagaattggggttgggaaaccttcgcctagatttcagaggatgtatggaaacacctggatgcccaggcaagaagtttgctgcaggggtggggtgccatggagcactgctagggcagtgccgaagggaaatgtggggttggagccaccacactgagcccctactggggcactgcttagtggagctgtgagaagaggggcactgtcctccagatcccagaatggtagatccactgacaacttacaccgttcacctggaaaagccacagatgctcaacgccagcccttgcaagcagccaggagggaggctgtactctgcaaacctacagggacagagttagtcaagtccacagaaactcacttcttgaatcagtgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcaggagggcaggtcttctctatgctgttcttatgatagtgagtaagtctcatgagatctgatggttttataaagaggagttcccctgcacaagctctctctctttgcctgccaccatccacgttaagatgtgacttgctcctccttctgccatggttgagaggcccccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcgttaaagtcatgacctagtttctgttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcttgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaaccttcggaagatcatctatttcctgctgggttgacctggaatgtgtgatatgacctaaggtaacctttgagtcaccacacagacctagagctctgtgtgatgcagcacttcctcaggagcttgcagtggcatcagggcccagccttgaatgccaggcaggggtctctcgactctgtgattcttcccaggaaatacataagaacttgcatctgggttcatatctcaaacgcaacccaccagtctctcacgtactgacctctgctccaagtcttcagatggttatttttcatggggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttatttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtaatcagtctcaattaggtgcctgttacgcagaacgaatttacttgatgaatgaatgtagggaaggaagagaggcttagaatgagctttcattgagctttctcttctctcgtgtctcattgctcaaaggggaggtgtacctcctcctttttgcagactctgtcatgcaaaggccgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgacgggcagggagagtagaggctgggtcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaagtcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagccctgggagctgagcagggagcctcactgtgggaaggtgaactgaggagtcctgatcagtcaaggcaaggttagagctgagcttttatctcagactcacaagggaaggtcttccctaggggacagtatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcaaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgtttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttatgtttaaatgattgttttgctggatatagcatttgtggctgacttttctcccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtactataatgtgtattgttatgaattgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctataatgtctgaggttttattcattcttctttataattttttccttctttatatgagaccatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaatccctggaaatttctaacagaaagattgatgaaaagagggtttttttaggcccccacaccagcctctgcctgggacctgactttgtctctgagccagtggaatctgtgatgaggttttgagttgggcagtgaaatcaccacagggcaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaaggatgtacctactgatatacatttaaccaaagtcactgtttttaattttcattttagtaactgacagcctatgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccggaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccaaatggaatgatagaatatttcacattcccttgtgcttccctcatggacaatctttgtcagttatcacccctcccacccagcaaaattaactgtctttctgacatctatacaatcatttaggttttcctgtcttaaactttatataaatagcattaagtgtatttttatctttttagacttggtattgctccttacaacttttgaggccttcatttctttcagaggattcaaggtcctgtcttatgtcatttcctgtgattctgaaggattttctctcaaatgtcttgtaagagacatagctgctatgaatgaatgtattttgtttatcaaataatttttttgctttttctttagatttgaagggtattttcgatggatatagatttcctggttgcctttttttttcctttcagcatttaaatatgacatttcactccttctagcctctattggtcctgatgaaaactcagccaatggctatgttgttgtttttctgtatatagtatctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgtacttttcatttctagagttccaatttggtcattttttatattttccatgtcttttcttgagcccctacttgccgaatcttctttttttttttaaatattttcttttttatgtcaatgatcatagatttaaacataattatttgaacatctgcatattaactgctttgtagtctttgctaaatccaataattgggacaagttagaattagctttcattgactattttctgttgttattattgtagctgctttatttttattcctttaatattgttcatacttctctgcttttttccagaagttgtgaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctcttggggtccagaggttctgcagcttcatcctcctgagtagctgggactataagggcatgccaccactctctgttatttttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatgtattttcaatgcaagatatagaaaaatctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggcttcactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaagaatatgcatccttaattattttatgctttgccaattttcagagtgctgaaatagttttgatatttcaactttatatttataggtgtgtttgttgtttattcttgcacagatttattaaactctttgtgatgccataaacagagatgccttctgaaatgcgtttaaatgaatgtaatagccacactgaaatggtatgatgtaatggactaacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggataccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagctttcagctgcaaagaccacctgcttcttcctctctgcactgagcatcctgcgccgccctggttgtcaggccagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttaaaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgcggcaattaattttgtttttatttattaaatattcagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaactcattaattctcatcatccattatcaaaatgttactctataaaaggttcccatgtcctgttgctgtccttctttcttacacaatctttattctaccctgttatcttttgtcttattcttgccccaggacaataaggaaaagctaccatcattacctgttgacttgctccagtataattttttcaggcttgttaccttggaaatgaggactatgtctggcaaagaaacatattcatcgggtcaatgtgttatgaaataaaatattttatctacttatgatccaataattaatttagacctacttgaacggtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaagtttgtcctgtgatgttatgggtgttgctgtggttgttgttgttaggaaatacagtggaagtcaaagcaagtagaaaatttacaagctctgctcttcctcatactcacaaccccttctagagatgacagatagtggcataggaatctctgacacctctaaggaagtcttttttgctctttccgggatctttcctgacaagtattgttttgagtcacagatgatgtggaagtaggtgtagaagaaaggactagagcaagggaagaagttttcaatcccaggtagttgttgtaggcacagggaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaatttttttttttgacagtatcttgctctgtcgcccaggctgtagtgcagtggtgcgatcttggctcacggtaacctccatctccctggttcaagtggttctcctgccttagcctcccaagtagatgggattacaggcatgtgccaccacacccagctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggtaagtcctctgtgatgctcgccattgtccccatgtctaacaaggatttctactggacatagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcacctcctgggttccagtgattctcaagcctcagccacccaagtagctgggattacaggtgtgtgtcactacgtccagctcatttttttttttgtatttttagtagagacagggttgcactgtgttggccaggctggtcttcctgacctgaaatgatccgtccatcttggcctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccataaaacaatgtgactctggcttcttagagtcaacagaacaggagaattcttacatccaagtgtcctgccttaaacaattgcacaaacataattagcagggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggaattcaaatggactatctagccaaaggccttatttcctggatcatctatataggcaggtggatagatgggacacttacaggtgtgcaggagccaaaatggggccaagcagtgtctgacatggggcctgcatgaagatctctccaggcttcccagctcggatgggttgggctcctatgggggaactggagcacggagcggctggcctgcatgaagcagtggctctgtggcctcttgcccatccccagagctccaacacctgtcaggaaagatgatggttcttaaaacagcctttggctagtgttaatagctctgcaatgttaacaactcagcataaagtcacacagacacacagacactgtagctttgatcgctgtagcgctgatcaccgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatattgatgcaaggcaagtcctcagctttgctcaggaaggaatgtaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaagcgctgtgacttctggatgtttctatggcaatggtaaactctcatggcactggtgggtatgtcttatggagaggtcctttcagaaccctgttcctgttttggccagcctcacatctggtcctgagcggagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaaaaaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataagaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtaactccaaaaagttttgtcctgctcttcagcaatcaacttgcttccacctcacagaacagaccatccttattcagcttattgttagtatagattccactatctttttaagaatttcacataaaggaatatagcacatgttcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagagttctcaatgtttcagctacttgtttttaagactttttcttaatcatcactcaacagtgaccagaatggctaatgatcattaagtcatgttttccttacaatttccttgacttttgtgggtgcttgacttgtatcaggatattgaaaacaggatcaatattgtcttaaccccttttaaacactttttctaagtaatgatatttaggatgataacaggagatctaaagggaatgttgggagtagtaacaggcattatccaatatttattatcatactccttaagacaatacattttgagtgaaatagcattcagctagactagggataaaaaggttctaatctcagctttagcattaaatattaggaaacctctgagaaaacaatccaggaagacaaatcagagggtgttttgctagtggagaagtgctgcaacacctaaaacctattaatgccagatttttgcagtgatttccactcataaagttgggttgactcctagccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattgtttcttatggcagggtgctcgggctcacacctgtaatctcagcactttgagagaccaaggaggaaggatcacgtaaggccaagaatttgataccagcctgggcaacatagggaaaccacatgtgtacacacacacacacacacacacacaatttgtgaacagtggcatcacgaagtgattatttatgaacaattggctaagaaaattacaaaataaagcaatgtcttctgagctaacaatactataataaagatgtcaattatttaactgtagaaaatacagagaacataaaattgtctatcttaaccatatttaaaagtgcagtgcagtggcattaagcatattcacatgttctgctattattaccgatactgtctccagaattcttttcgtcttataaaaactaatatctataccccttaaacaatactccccccgtttcctctatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatctgtcccccaaggcatacgaaagttatgtggagctgatagagtcgactgtgtgtaccccgcttgcatcacagctcaggaatccggaaaagcagacactctgggttttatatcctggggtaatgagacgcacagggctaacgtgcttaaggacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctacacccaccaatgtcccccaaactgaaggcagaggtttatcttttcagattgacgaagcaccttgatttacacaatctcagtgcagattattaagccatagtgagagtacatttcgctggtctaaggaaggctactaccactggcaggaggataagacccccaaaagcagtgacctagtctaggatcccatgatcaagaaattaagatgtcaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccatggtagcccgagcatctaatagagtgacatatatttagcagtccaggaagcaagctattgccatagtccttttctccacacaggggatcctttagtagttcagtcactcagttgctgttttcctgaccagatgactgggttgttgaaagtggcccatgatttaatggaaatggagcaaaatatagtgttaggggcagcctgcatggctgctatcattgtatgtagtttggcccattgggcagaatggccatgtttagtgtcaatcaaaagatgccatcccctggctggatggtggccacacccagtggacccactggcatgtgttttgtacaatcatcagggccccatgccatattgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattcttactgtaacatttccatttagtaatttggatctgttgggcctgtccagttttattgattgtgtttgtaggcaccaaagtgagaatctgtagttaaggtagcagtgtcactcctggtcctctagctctgagatactcaggccctatcagtttcctacagcaagtaaggagttgccattcaaaagaggcacaaatggtggctgcttcaggaaacatttgcctccaaaatctaagtctggtgcacccagtgacaattttacattgccacagactccagtcagcatgcctagaaatagtggacacctggatttacatcgagcaagcaggctctaaaggtcttaaagaaatgccttggacatgtattgttgaatagattcgaaggctaccgttgcaaagggctccattcaaagttgtcaaatttgttcatgcttttgactaaggtgaccaaaaaaaaaaaaaaaaaaaaaaaaaaaagactcagggggacagtgcagctaggtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagcatctcctgcgcctgagactccacattcaagctgtctcttgcagcagaagagagagcagctcttctcactactgcccccagaaggacagcagctctggtatcaactatcaactgctagaaatctgacccctttctctgactgcccatcagatgtgttactacagagtcgttttggattgagatgagggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttaggtccaaatgattcagtgataaaactaaagagaaaaaataaatacacttttcaacgttgaagctgaccaggtgtctgtctctggtgtttacccctccacatcccacgatgtgtttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaagtcaattatgtttgctcttgctttatatgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagtgggcatagcaatgatgagtctacagctcattttcaatatataaatattctgtttatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcattttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactctatccagcgtgcattgttgtgagaactctatttggcctatcatcattgtgggcatgaacataatggagactttcataggatgcaatggttaatattcaacattagtcaaaatttgctctagtcctaccctcggagctctactgggttggaaaaatattttaggtaaggacaaccatttggtaaagttttaaaaataaaggctacaaataaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcatggatgctcacgttcacaatcctctggctgaccaaggaagggctctgatgagtcgttcctctgcagggcactgagctcaccttcagcctacagatatgaattgtctgaggacaaggctgaacagcagtgactacacatgacacaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgtttccaacatgtggcttcaaatataatttatttaaatggactcattggggtaaaaatcattttaacttatgtaaatatccctttttgctgtgcttgtgtcctatagagttgcccaataagagttcctcccgtgagatttggaaatcagaaaaggaagactcaatattatccattggtaactaagacaggtacaaggacagaggtgaggactggagaaacacctggaaggatgttgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgctgctggaatgcaattgaaataggccctgttatcccatggaactaaggtttatggttttttgaataaacttagaaattgtctccccctccctgtcttaaaactcaagatagttacatctgtcttacctgagtcctttttttcagtaaaccaaccatcaggcctcccagatactattaagaagctgaaacttacatatcactgaattgggacagtgagacatcagaaccttcacccactgtgattgcataactgacctcctgcttcttcttgaccaaattatcttccttacccctccctaattcctgttttcaacatttcttccctcctatataaacccctaattaattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagtgcaataggtaatatttccctttttcatggaacactgactttttctttgttcttccaacgtactgaagaccactgagttttcctgtatgcctcatttggcaaatatttctcttcaaataaaacattaaatttagagattcatctctacattttatttagacttcagcagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgcagttggtgctgagaaagagaaaagaattagggtgcagaggtgacttcatgtccccatctaccaacaccatcagagtgtggctgcatctgaggaacactctcagctgatggaggcatcaggagaagctgctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaactttgatgggaccccactttgcaaactggatgcagcatagatcagggacttaggggctttccctggtttctgctgaaaccaggctaaataattgctaatgccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggactctcatgtccatgctgtgtcctgactgggtctgattcctgcacagtctgaccagcctattaataaggcttcagggcaggaggttgtgctctgggaacatgcaaatgagcaggggatggggcaggctgggcacagctgcagagctggcgcatctcagtaactcagcaccagctcagtgtccccacgtgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgctcctttctaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatatccagagactaaatgggctgcaccttattcctgttttgcaccttattcctgttttgggcaccttcatagtctaccttcttttctgccattaagtattatttcccaacattcatctctcttagtgagggtgatcactgcatggagcatgtccctgccatgcaccataggtgacactttcttcttttactttttatcagggacatcatcctgacccagacaccaagatccctgttaacatcttttggaaagaggcactcaatcttttatcaagcaactgcccaggtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgagatccaggtgtttatgtttcctttctagggaagaggtaattgggaaatgtaggcaacctggagagaatagatgagaatagaaatgcatcctcaaaagaacaggtaatcacctccctaggtaaagtatcaactttgagtctcttccatttttgattcctcttttgtgttaatcttccttgatataaaaattctcaggaagagttttcttaaaaattggtttccttctgaagaatttgcttttaggcaggtaggggatatttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttgtcccctcaacaacgtggaggttggggcactgaccactggtgcagatgaaaacctgtgtagaacttttgcatctccaagttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttgtaaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagacgaccttaacctgcccatgccttgatcttaaatttcccattctccagaaatgtgagaaaataaatttctgttctttatgaattacacagtggcaaggaacctaacctgttatagcagcttgaaagagaacaagagagacagctcacaatcagtgaggacagaatgaggtgtatacataccttagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttctttgacatgtaggaatattcaggaaacacacaattttttttttaaccaatctattttagattgaatttatgcggtgattttttgtgtgtgtgtgttaaaacaaaaaattacgttgtaagccactaaccagctgaacggactcctcttttggtagagagaacttcaaagaaatctgaaaaactaggttaggccatgactggcaggtgggtttagatgtacctcattatatggtccttcctttggagttcagacacaactgaccagcattatcattacaacagagatctttggattgacaaaacagatgctttgtagcaataagataccatactccaacacgacagataataggccctgaagaaaatcaaaatattttaccctaaaagtatttctttgacatattctgaagtggccctgcaagctgcctgttgtgggggaaatttgcattctgcagagaatctcctccccttactaagtcttttccaaagagtctgacattttttttaaggtctgataaacaacattagccacctactttgtttgctacccataggattcatctaggtgacaagaacctttgcttccacacccccttttctaaactcaagcatttctttatgatgaattcaagtgtttaggcagagcttaactctttcaaccagttggcagtcaggaaatctttgaatccacctatgacctggaagcccctacttcaagctatcccacctttccaggacaaactaatgtaaatcttatatgtattgatttatgtctttccctgtaatttctgtctctccaaagtatttaaatgtgtattcttgtcaccctgggcacatgtttgcaggacatcctaaggctgtgtcacaggccataagctttgggaaaataaacctataaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcagataggaaaagagtgtccttggtaaggttttctttcctttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtagagaatattttggcaccctgcatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcttccttccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaagagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtatcgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacattcctttttgattcatcaattgctgtctgttataatttactaatttgcatatttaatatatcgataattattgatatactaagatttaagtctttgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacccttcacaccatctctagcctacttataatacctgacgcgatatgtatacatgacttaacctgtgtggattcaaccaagtggtactaagcacatggtgaagtcaagtttttctttttggaactttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacagaacattggtaatgaagaagctgaactgctgtcatcagttattgttatcatctgaaatgcatcatatattaccaaagtctccccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaaaaatagtgtgaaggagttctcggttatttatacttggatatcaagcagaacactataatcaatgaagctataacctaaaaactttaagacttttaaagaggtttcccttttctcagggtatttctcaggaaaaaatttataaattatggataaactacttgcacaattagctacaataaatcccttccctgcactcatcctttggttggcctcattctaaatggactcaggtgttacccatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctacctgttctctgtggaggtagatcacacaatgccatgactcactggagacaggtttctgctagggtgttctggcatctttagtttcctcaaatatcagggtactcgtactgagtgtgaaatctctcctacatctacttcatcgtgctgtgtctgactgatcagacatttgacacatgacttttttttttttttgtgacggagtctcactctgtcgctgaggctggagtgcaatggcatcatgtcggcccactgcaacctctgtctcctgggttcaagcaattctcctgcctcagcctcccgagcagctgggattacaggcacccaccaccatgccaggctagtttttatatttttagtagagacggggtttcaccatgttggccaggctggtctcaaactcctgacctccggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaagggtctttccagcccctttccagcagaaagacaggtgctaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcgtagggaaggcagaaaggattaggatgcccttctactcagctttatctgctgtcaagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattagcatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaagccccattttagcacctcttggggctgtagatggaaagaacttggatttaaaactattttcaataagtgtctgctaagtgctaagtattatagctataaggatacctaaattaatagaagcacatattatctgttggatatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaaggcttggaagaaaagttctaatcagctcttcattcccacctgatgcaatttttgctgctgctgggaccccaagttctttgtctcctccccgccgcttttttttttttttttttttttttgagacagagttttgcttttgtttcccaggctggagtacagtggtgtgatctcggctcactgcaacctctgcctcctgggttcaagtgattctcctgcctcagcctcccaagtagctgggattacaagtgtgtacccccacgcctggctaattttgtatttttagtagagatggggtttcaccatgttggtcaggctgatttcaaactcctgacttcaggtgatccacccaccttggcctcccaaagtactgagattataggtgtgagccatcgcgcctgaccccttgcctcttttgtaaatagaaatcaacaccaggccaaacagaaattgtctcaggcaaggtttaataggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatggtgaggaaatggaggataagccctgccttgggtggatattttagtattacaatgagattataatgaggaaaaatcagtgaaaggtcagttctggggaccatcccaccttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggagggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactctatctgaagaaaaaaaaaaaatgaaatcttgagatactcaggccctatcattttcctacagcaagcgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgtatagattccaaggctaccgttgcaaagggctccattcaaagttggcaactttgttcatgattttgactaaggtgaccaaaaaaaaaaaaaaaaaaaaaagactcagggggacagtgcaactaggtgagaacccagtggctttcctgagcttatttgtcttgcatttttgttgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgcttgagacattcaagctgtcttttgcagcagaaaagagaccagctcttctcactactgcccccaggaggacagcagctctgctatcaactctcaactgctggaaatctgacccctttctctgactgcccatcagatgtgtcactacagagtcgttttggattgagatgagggaggggaaatgtctgatttcactcaaatgtgctcattttcctggtctgggtctcagccaggcagcacagtcctgtgggcacaatatcttcacttgccaggttcctataaaatgagagtatctttcttgactgtggaaaatatggaggcgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaagtaaagagaaaaaataaatacacttttcaacgttgaagctgaccaggtgtctgcctctggtgtttacccctccacatcccactatgcatttcatcttccctttgcctcactggagatccaagtgcaagtaatgcttcacatgactgtgatccctagaacttcatcctgatgactgttgaaatcttctctgagttttaccagtggaaatggcaataaatagaaagattccagaaggtcccctagggtccatattttctgtacttcctctctaaaatatgtaaaatcagttatttttgctcttgctttatatgggctacatctatggccccagcacacatctgaatgccctgtgttgacaacttatccagtattgtattaagtctaaatggtgacatgcttatcatatcatttcttccaatttcttggaataattgtcatgtcaattctttgcattaagaaccatcagccagaaaaccacagccctgagaaaatagaaatagagtatttcaagctgttcagttggcacaagaatgatgaatctgcagctcattttcaagatataaatattctgtttatggaagtaacagcaccattcatgattagtgtttcagagcctccaccacttctgacagcatagcaattcaatagcacaagggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactccttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagccccctggtcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagggcttccttgacaatggcactgatgtgactccatccagcatccattgttgtgagaactctatttggaatatcatcattgtgggcatgaacataatggagacttttataggatgcaatggttaatattcaacattagtcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccattttttttgtgtggaatgtaacaattatttaaatgtatataatttagataatattttataaataaaatatgtatatattgcatatataatagaataaatgtacttaaatatgaatactgtacgtagttgtagccaacattttatcaaataaatatatattcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcatgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacatttaaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaaacaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaaacttccagacaggactgaggaccacatgggtagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccccgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccgtgctatataaacccctaatttttgttggtcagggagatacatttgagaatggtgtcccatctcctcagctacagcacctgattaaagccttttccttggcaatacttgccttagtgattggctttctgtgtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattaggagaggcattgctatgtctgtgtagttggggctgagaaagagaaaagaattagggtgcagaggtgacttcatgtccccttctaccaacaccatcagagtgtggctgcatctgaggaacaatctcagctgatggaggcatcaggaggagcagctggggcagcccagcctcacacatctgcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggcgcttaggggctttccctggtttctgctgataccagcctaaatcatttctaatgccctgacttgcccggcaagtgatggtgactctgtctcctacagatgcagacagggaggatggagactgggtcatctggatgtcacacctggcacctgagattggaaacataaaaacaaatgtccacacaattaatcatgttgtaagagaatttccctgaacagtaaagcagtactgagcactctgggctgagtaaactgctagtgttctccatccttacctgggaaccagagcagcaggagccccaggagctgagcggggaccctcatgtccatgctgtgtcctgagtgggactgattcctgcatgaagtgtgtccagcctattaataaggcttcagggcaggaggctgtgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattcctcaggagtcggtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatatgcagctagagagaaaaaacagatcacctacaaagggaagccatcagactaacagaagacctctcagcagaagagattgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacaccgttatcagccactataaaaacacactgaagtacacagaccagtgacattataaagcaaccacacaaacaagttggcaaaataacaggctaacagcatgatggtggtatcaaatctaacatatcaatattaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaccaggattttaattctaattcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttgaaggagacttagattcccacacaataatagtgggagatttcaacaccccactgacagtattatacagattataatctgtataattaattttctgaggcagaaaattaacaaaggtattcaggacttggactcaaccctggatcaaatggaccttatataaatctgcagaactcttcaccccaaaacaacagaatatacatattctcatcaccacatggcacatatgctaaaattgaccacacaatcggacatacatcaatattcagcaagtgcaaaagaaccaaaatcatgccaacctctctcggaccacagcaaaatgaatgtagaattcaagactaagaaaatcactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaatatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagggtgagtatccaaatacataaaattagaagtgacaaaaggacattatcactgaccccacagaaatacaactaaccatcagagactactatgaacacctctatgcacaataactagaaaatctagaagaaatagataaattcctggatgcatacaccctcccaagactgaaccagaaagaaattgagtccctgaagtgagcaaaaatgagcttgtaattgaatcagtaataaatagcctaccaaccaaaaaaatcccaggtccaaatggattcacaactgaattctatcagatgtacaaagaagagctgttaccattcctactaaaggtattccaaaaaagtgaagaggaaaggctgggtttggtcactcatgcctgtaattccagcactttgggagtccgaggtgggtgaatcacctgaggtccggagttcgagaccagcctggccaacatggtaaaaccccgtctgtactaaaaacagaaaaattaggctggcatggtggcatgcgcctgtaatctcagctacatgggaggctagggctggagaattgcttgaacccgggaggtggggcttgcagtgagccgagatcacatcactgcactccagcctgggcaacagagtaagactgtgtctcaaaaaaaaaaaaaaaaaaaaaaaaaaaaaaatatatatatatatatatatatatatatatatatatatatatataaaatcaaggaggagggactcctccctaactcattctatgaggccagcatcataccaaaacctggcagagatgcaacaacaacttcaagccaatatggttgatgaatatcgatgcaaaaatcctcagcaaaatactagcaaatcaaatccagcaacatatcaaagagctaatctaccatgatcaagagactttatccacaggatataagtttggttcaacatatgcaaataaataaatataattcatcacacaaacagaactaaacacagaaatggcttgatcatctcaatagatgcggaaaagacatttgataaaatttaacatcctttatgttaaaaactctcaacaaactagatattgaaggaacatacctcaaaataataagagacatttaggacgaagccatagccagcatcacactgagtgggcaaaagttagaagctttccccttgaaaactgtaacaagacaatgatgccctctctccaccaatcctaacagcatggtgttagaagtactgaccagagcaatcaggcaaaagaaggaaataaaaggcacccaaacaggaagagaggaagtcaaactatccttgctgcatatgacatgatttcctttttttttttgagacagaatcttgctctgtcacccaggctggagtgtcgcagtataatctctgctcactgcaacctccacctcatggagtcaaatgatcctccatcctcagcctcctgagtagctgggattacaggtatgcaccaccatgctcagctaacttctgtagttttactagagatggagtttcaccacgttgaccaggctggcctcaaactcctgatctcaagtgatccacccaccttggcctcccaaggtgctgggattacaggcactagccactgcgcctggcctcacatgaatatatctctagagaaccccatagtctcagcccaaaagctacttaagctgacaaacaacttcagccaagttccaggatacaaactcaatgtacaaaaattactaatatttctgtgctccaagaagagccaagctgagagccaaatcaataatgcaataacattcaaaattgccacaaagagaaagaaaatacctaggaatgcagctagcccaagaggtgaaagatctctataaagaggactataaaacattgctcaaagaaatcagaaatgacacaattaaatggaaaaacattccatgttcatagacaggaagaatgaatttcgttataatgaccatattgccaaaagcaatttatatattcaatgctattatcattaaagtaccattgtgattatctacaaactagaaaaaaactgttttaaaatttatatggaaccaaaaaagagcccaaatagtcaaagcaattgtaaacaaaaagcacaaagctggaggcattacactgcctgacttcagactatactacaaggctacagtaaccaaaacagcatggtactggtacaaaaacagatacatagatcaatggaacagaatagagaacctgcaaataagactgcatacctacaactatctgatctttgacaaatttgacaaaagcaagcaatggagaaaggattccctattcaagaaattgtgctgggataactgggtagccatatgcagaagattgaaactggaccccttccttacaccatatacaaaaattaactaacgatggattacagacttaaatgtaaaacccaaaaactctaaaaatcctggaagacaacctaggcaataccattcaggacatagacatgggcaaatatttcatcacaaagacaccaaaagctattgcaacaaaagcaaagattgacaaaaggggtttaattaaactaaagagcttctgcacagccaaagatactatcagcagaataaacagacaacctatagaaagggagaaaatgtttgcaaactctgcatctgacaacagtttaatatccagcatctataaagaacttaaacaaatttacaagaaaaaaatagccccattaaaaagtgggcagaggacatgaacagatacttttcaaaagacttacaagtggccaacacttatatggaaaaaagttcaatatcactgattgttagagaaatgcaaatcaaaaccacaacgagatatcatctcacaccagttagaactggtattaccaaaatgtcaaaaaataaatgctggagaggatgtggagaaaaacgaatgcttatatactcttggtgggagtataaattagttcaaccattgtggaagacagtgtggcaattcctcaaagagctaaagacagaactaccattagacccagcaatctcattaccgtgtatgtacccaaaggaatataaattgttctattatgaagacatatgcacgtgaatgttcatttcagcactattcgcagtagcagacatggagtcaacctaaacgtccatcagtgacagactggataaagtaatgtgattatatataggtcagttttgcctttaatttgttgctcattattgtgagccttaacatacttctttgtgaacttgccactgtttcaatataatattgtaatctttatttcagagtttattgcaaacatttatggttaagtatttgatatattttatagagtttacttccttgttgcttattgaaatttgattttataattgtattaaaccaatttaaatatatttaaattcaaacatagaaataaaaaattgaagtgttgatatgtctaacaaaaagccaatgcacaaattaccttaaaagattaattaaatgtctgaatcactaatttaataatattttcatgtttaaaatgtgtcaaatatatttttgagtcctagatatgtgaaagttttgtgcaatgtactgtaatatctgctaagacacactattcttttcttatcaggtgaattcatatttgaactgcaagttaatttcttgaactgcaagaaaagaggcacctaggaacatatttgaaaatgcgtaattttaaagcagctaaaattatttattaattaataattattttctgagtttacatattagacaaaaaatgctactgagaagatatcactggtttttgctctgtaacagaattagttatatctcgaatatgttgccactcacctttcctaggcacataggagaaatcaacaaatcattgtctttttttactgaaagaggaggagcaccaaaatctgtcttgaccacagctctagaaggtaccttattaaacactgtatcatccttgccctattaagtaagtgcttgctaaattgcattctttttgtgctttgaattttcaataaatacattctgagaaaataatacaccgattggaatgcttgactattcaaaatttcaggtatatactccattattttattggtctttctcttatgatccaggcagcacaggatcaggtcttctctagaactcactgttgtatttttatgccaagagcttcagtagacaatcagcaaatgggcttgcagtcggcaaaaatagttacatagagctgatgatttctcatagagacgagggtgttaataggaaaatatttctttacttattttttcttggtgaatcaataataaacagagaacttattttcggaaataaattcagaaagtcaagtatctaaatctggtagggatgcccatagaatttttataaggaacatatataattttatttctaaaagtccatttaatgttattagctagtacacgattcaaaggacaatttaaaaatcaggtaaatgtagtaaaggcaaatacatatttttgaatgaataaataaatttagaaaagtcaataaatataaaaaccatgtgcaaaaagatcataccagcaacaaacaaattggagatggaattgtgaaatatgtgatccgcccacctcccaaagtgctgggattacagactttagccactgcgcccggcattttttttttttttttttttttaagacagtctctatcgcccaggctggagtgcaatggcacaatcgcagctcactgcaacctccgtctctcgggttcaagctcttctcgtgcctcagcctcctgagtagctgggattacaggtgtacaccaccacgactggctaatttttgtatttttagtagaggcaggatttcaccatgttggccaggtgggtcttaaactcctggcctcatgtcattcgcctgcctcatctcaaagtatggggattattggtgcgagccactgcggcgggcctaagatgtgaagtcttgatactgtacaaaacattattaaaatgttaaagaagacctctagattgtggttttggtttactatccaaacaattacaccatctacaaataataactattcgttttctttatttccagtactcatgtattttatttctttttcttgccctttatactagtaagaggtccagtacagtattatctaggaatgatgatactttacatcttttaaaaatatctaattccaaaatgaagaaaaacaatttttcagcatttattgtgattgtgtgtgtgtgtgtgtgtgtgtgtgtgtgtgtctgtctgtctctctgtctgcctgtgtattctctaagaggtaaggaaggtatttttccatttctaattttctaggacatttttacataaacagggtctaaattttgtccagtgcttctttctataccaattgagacgaccatataccttttttcttctttaactatgtcaaatgtggtaattatactgatcaaatcttttaaatccttattatgttattttctgcttttctatcacctcttgagcataaagtctcccaccataacatggagttgactttttcttaatttaatcaattttttatttatatatttttaagttatgttttgggtctatatagatttagtattttaatgatttcctaatagattgacccacttatcattatgaaatgtccccttttctccttcgccttaaagtataagtcaggtttcgtcaattcagtttttgcatgatatgtacttttcgttttttaattttcaaagtcattttatgatattattgcagtgtgtattttataagcagcataaacctttcattttaatcttgtttaataatttaaaaattttacttagataaatttgtctgtttatgatgtctaaattattggtagttagagataaatctaccatcctttttttttcaaatttcctgctttcttgctttcctttggattagacattttgttatatttttccttacattaacttgttaaacatgcaatcatttattatacagcagctatcctcaacttattacttcctagtaccaaatattaatttaccatttcctaaaatagagttagatttttaaattccatttacactactttttcgtgttatttttcatgcaattcagttatatatgcattgcaaaattcacaaaccatgacatctatagtcgtgtgcaaattttagtttgtatttattcctatacatatcctttccagtgtctatctcttatgtatctttatgtttctatttagtcttgcattccttctgttgcagaactgtctttagcatttcttttatagagtactactgatatatagctgcctaatattttgttgttttacaaacagtatttatttgcacattcattttgcctcatttttttctttccttttcaaaggccccaaagatgttaaattacttactgatatttattttccttggaaggattgagttccttttgagttgtttttcttacatataaatattgccatacaacttcatactcagcaaagataatacatagatatattaagtatacttgccattggatatattttcttggaaaaggcagccatctgccagatagcttatgtccttaatcaaaagcaggatcattttgatttaattcaaaccatctacttctactatagcatgatgaaataatacatatgcccttttatggatcaaaataatattaaagtattattgtaaatgtagtatatttaaagcatatgtgtatgtaatttcagcatacattactggaatattgaattcagtgttccatgtttggtattcagtatcaaatattttaaacactgacatgatcattatcatttctgcagttgtttttctccttcatttccatgtgccatgtgcatttattgatctagatgtgaatgttttgcaatataatattcaaactgacatccctactttgtaatttaatagaacaatttattttcagtagtgaagtagtaaggaataggccttagaagatggacacaagaattgcaataaattcaggagagcaaaaatgaacttaaaaaatcatgtttgttataacatcagagagttgtggaacaaataaagaacagatagcctaaaattccacagaggaaagatgcctttgtatattgccttgtgtcctcctgtcactttgtgtcttagtgaaatttgccaaatacgagcgtgattggagattctggtttggtccaggcagaagatctctacaagagtggggaattcatctcacctttggcagaggcatgtacgtgccttacagattatggattatatggcatgagtggagcccttaacaccaggctgaatttctctttgggacatttgttgaggcctgggttgagaatggtagctgggtgggttggctagagacacacagtgaaacctcctgcattctcctgagttctcccctaccatgctgccttgattttcctttatgtgtgtctgaaatatgggctttgggctcccaccactacacctcctactcatcttcccagcccctgcactgctctggtcagcatcatctttattttaactataagctttcttgaatgatcctttctttctctaatcattcccaggtaaatgatgggggcagaatctacttttccaaggtcttctacatcctgctggattgactaggaatgtgtgatatgacctgaggtacatttggacagggactctctttgagtcactaaagactgtgtgatgcaatacttccctgggagtttgccattgcatcagagcacagtcttgaactccacgcaggatccccacaactccccaagaaatacagcagagcttccacttgggttcatatatcaactccaacacaccaccactaacacagttaacagctgccctcacattctcatttactgccctctgcccaaagtctatagattattatttttcaaggggcaaaatataagcttatatattattttatattaatccagattccattgaatatggcatacatttttgactatggcatacatttttagtcgttttttcttttgtcttttgaaacttggatatttatttttaaaacacagctttggatttcatagaattttcttttcatttcaacatactgtgaataagattgttcaaagatttttgtcactaggtctttgtttttgcataaacttaccaaaatatatctagcagttacaaagtctagaatgtaaatacacgcaagcactccctgaaaaaaaaataggataaaatgctgtgcttcctgctgtcccagagagagatatatgttaagaaaagtgtaaagtggaaggtagaagatgggagagaaactgttttagtatcaccaaatcttgtcaaggtacatgtacactagtaactgctaaaccaaatcaaaaccaagaacgtattagttttgtattgccactaatctgtttcatttaggtggctgtcaggctgaatgaatttagttagtgaatgaacgtaggcaaggcagagaggattacgatgagctttgattcagctttcccttgcaacatgactggttgttcagagggcacttgacctccctccattctcctgcaagttctgccaggccaagactcttgcaactgatggggactaaattgtggtacctgagatgtaacggagatattgatggtcaagagccctcagctgtaatgtattctcctgaattctccatcatcttcctctttactctcccaagataatagacagtgtctgctttccagataaacaacacatttgggcagctgaaccacagcaagaagggaggtttctgttcagggttgtaccactgtgttaggaaactgtgtagcttgcatgcagtaataaaccccaacatcctcagcctccacccagctgattttcagtgtgaaatcactacctgacccactgccactaaacctgtctgggaccccagaaagatgattggaaaccctataaatcaggagctgtggagactgccctggcttctgcaggtaccaatgcaaataggtatatccattactatgcaggaggctctgactagacctgcaagagatggaggccggctctccagggttgacgggcagggagggtggagtctgggtcatcacaatatctccactggatcctgaaatagtgagagaagtgcaaagttatgtacaaatattgggaaccattgaaatgatattctttctgttatctactttatgctaagtgatttttttgtgtgactttggttcatacccctaaacatccaggcataaaaagaaccaacattcacaaggcacaaaagagactcaagaagtcgcctacactattatcctcttcctgtgtgacactcttcatgagagcacaagtcctttgtccttctaggatatgaagtttagaactataagagtgaggaatcttctctttctgactcttgcagttctaaactttatacaccttttcttgcaggtcaagatgtgcatgtggacaggcagtgggacccccagagctcaccctcacactccattctcctcccttatctcccttctgtccttaccaggaacccaaagcattagcagccccaggagctgagcagggacccttattgtgagaaggtgagctgaggagttctgatcagtcaaggcaaggttacagctgagcttttatctcagactcacaatggaaggtcctccctaggggacagtatgcaaatcccctggtgggtgcagtggggtggaaagagccaaggagagtatggggacatctagtgtgagcacagtgacataatgtgtcctctgtgtttagagggaacctaataaagtttgtgctgcctgagtggaaaaagggacatatttaatcatgttcttctatttcctctaagagatttctacattgttttcactttcccagacacattttacacttgtctttaataggctgagtttccataaatatttggttattcttatttaattttattatatatatacacacacatacatatatatacacatatgtatatatgtataaatatatatatttttgatatatataaatatatataaatatatatattattttgtgtataaatatatatatatatattttgagacagagtttcacttactctgtcacccagactggagtacagtgtcaggatctcggctcactgcaacctccgcctccaaggttaaagcgattttcctgcctcagcctcccgagctagctgggattactggcgtgcaccaccatgcctggttaatttttgtatttttagtagagatggggtttcatatgttggccaggccggtctcgaactcttgacttcaagtgatcctcctgcctccacctcccaaagtgctgggattacaggcatgtgccaccacacctggccagttattcttatttattattttcatatttattttagcatctaggtttttaaattagtttcattttagttgacaaaatccccagagtaaagggcacaaatattaagagtgtaactgaatgaagtttgtgtatattaactgtcaaggtggaactatggaatatagatttttgtttttctttttttttttgagatggagtcttgctctgttgcccaggctggagtacagtggcccgtgatcctggctcactgcaagctctgcctcccgggttcaggccattctcctgcctcagcctcccaaggagctggggaccacaggcgcccgccaccatgcccggctaatcttttgcatttttagtagagacagtagagaccaatatcatattccctcagtaatgctctgagctctactccctactagcatgttcttgtgaactcaggaactgctctcctagaccccggctttctggagagcaggtgagggggaggcaccagggaaaggccaggtcattgagctgttgggtgtatgttcctgctgtgcaccatcaatgccactttcctcttttacgcttaagcaatgaatggggacatcatcctgacccagattccagcttctctgttgggattggtaggagggagagtcttcatctcctggcaagccactgcttacgtatatggaaaagtattttagattctaataaaattggacaaagatttgaaatccgattttttacatatctaacttggccctgattgtctcagcctggttcagcaacagaaggagtggaataaattgcatcagcatcagtagactggagcctgaggactccagggaacattcgcacgcaagactaggggaggccaagtcacagcagtctagcctgtgcaccgtcctcctgtggcctttcatgagcctgattttttagagaaacttgcttacatccagcttgccaggatcaaattctagagagacgcagatttaaatgtaagttcgcatcttttttttttcctgcgtggatgtgctggaatgatggaggaaggagttatggagccaggaatatgacggtatcttgaagattaaaatcaagaaatccgatgttctcccctggagcctccggaagaaatacagccctagtgactccttaattttagctcagtaagacttctcaatccagaattgtagataataaatttgataggatttattgtagataataaatcatactgaatgcggtataattgtggtaattagttgccctagcaataggaaactgttacaggcataaggcatgtcttttatctttctaaaagtgtgattgtccttcttcttctaaacatttccattgtgttatcatttggtgtcaattttgatcagaggcagagaacattttactgcgaggacagctagcaccagaattcttaggtggaaaatctcttgtgagaatccctttattaggtctcatatgatctgcatgtctgagatcctaggggtcagctctcacagcacaatgtgggggagcatgtgtggttgtttgtttcttattatattagtaggactcgttagattttcaggacaggatctgagaggaaaggaactaaaaacaaagaccatatggtcatctcaactgatgcagaaaaggcgttcaataaaattcatcatcccttgattttaaaagccctgaacaaactagacattgaaggaagatacctcacaattataagacctatatatgacaaacccacagccaacatcatactgaatggtgaaaagctggaagaacttcctctaagaaccagaacaagacaaggatgcttattactctcaccactcctattcaacatagggctagaagtcctagccagaggaggagaggaagtcagtctatctctctttgcatctgatataatttatacctagaaaaccctgtcttcactgcccaaatgttcctggatctaataaaccacttcagcaaagtttcaagatacaaaatcaatgtaaaaaaccagtagcatttctatataccaacaatgtctatgctgagagccaaatcaagaatgcaatcccattcacaatagccacagaaaataaagtacttaggaatacagttaaccagggtgctgaaagatatctacaactagaattataataaactgctgaaagaaatcagagatgacaaaaacaaatggaaaaatatttcatgctcatggatggaaagaatcaatattcttaaaatgatcacatagcccaaagcaatttacagattcaatgctatttatatcaaactatcaacaaaatttttcacagaagtagaaaaactattctaaaattcatatggaaccacaaaagagcccgaatagacaaagccgtcctaagcaaatatgaacaaaaccagaggcattgcactacccgacttcaaactatatactacaaggctacggtaaccaaaattgcatggttctggtacaaaaataggcacataaatcaatgtaacaggttagagaacccagacttaaagctgtacattataaccatctgatcttgacaatgttgacaaaaggtagcaatagagaaaaggctccctatttgataaatggtgctagcataactggccagccatatatagaagattgaaactggaccccttcctttcaccatatacaaaaatctactcaacatggattaaagacttaaatgtaaaacctaaaacttcaaaaactctagaagaaaatctaagaaataccattctagacaaaggccgtagtaaaaatttcatgacaaaaactccaaaagcaactgcaacaaaaacaaaaattgataaatgggacctaattaaagtaaagagcttctgcacaagttaaagaaactataaacagcgtcaacagacagcctacagattgagggaaaatatttgtaaactatgcatccgacaaagacccaataaccagaatctgtaatgaacgtaaattaacaagcaacaaacaaaaacaaccccattaaaaagtggccaaatgacatgaacagactcttcttaaaacaaaacatgcacatagtcaacaagcatatgaaaaattctcaacaccactaatcattagaaaaacgcaaattaaaaccacaattaagtatcatctcacaccagtcagaatggctattattaaaaactcaaaaaataacaaatgttgatgaggttgcagagaaaagagaatgcttatacactgctggcgggagtgtaaattagttcagccacggtgcaaagcagtttggagattcctcaaagaactttaaacagaactaccttttgattcagcaatcctattacagagcgtatacccaaaggaatataaattgttctaccataaagacacatgcacacatatgttcactgcagcaaagacatggaattaactaaatgcccatcagtggtagacagaataaagaaaatgtggtacatatacatcacagaataccacccacaactgcaacaaatacaagacaaagttcagattatggaccgtagttggcctctactatattctcttctttgttctcattcctggagtctgcccacagttttaaaattctcaccctttggtaaagaaaaaaaaaacctcacattattctgtgttattctagtggcatataacataaattctataatctgcttgttccagtttaagtttttgtttttaaaatccaacttttggaatttcaaatattatccttttttattagcaagaagtaattgaaatgaatgaaagagttttaacatcaggatcttctgtcttccatgacgtcacaaaagtctatttggaggtgcaaattcaagctttttcatgattgtcctcagccagctctccctgaggacagcttgtgtagaatgctcttttcactatttgttatgtggtgcaatgggaagagaactagtaaaaaggagaagaaggaaattggaaaagttgaaaaataccagtttctaaatactaccaaatactaccctcttaaaaatatacacaaaagacctaaacttcaagagatattcaacacgtgttgacacgaatctgtgttacttgtctggctattaagctatttgaagtctcattgtcgaatgtaggcaaggcagggaagattagtgtgagatttccctccgctctccctcagtcctgtctgcttactctgaaggcacttgaattatctctgttttcctttggcttatgccatgccaaggctgtgggagctgacaggaccatgaatgggttttacctgatgtactgctgagtcccccatgggacaggtcattcagctgcaaccttttaccctgagctcaccaacatcttcattttttttttttttttttttttttttgagatggagtctccttctgtcatccaggctggagtgcagtggtgtgatcttggctcactgcaggctccatctcccgggttcaagctattctcctgcctcagcctcctgagtaactaggattacaggcgtgcaccaccacatccagctaatttttgtatttttagtagagatggggtttcaccatgttggtcgggctggtctcaaacttttgacctcatgatctgcccgcctcggcccaacatcttcatcttatacagcagagattctgttgtgccactccccagataaacaacatatttgagcagctgggccactccaagcagggaggtttgtattcagggttgtaccactgtgggaggcacttgtgtaccttgcaggcagtaataaaccccaacgtcctcagcctctaccctgctgattttcaatatgaaatctgtccctgaaccactgctgctgaacctgcccgagaccccagacttcctgttagaaacttcataaatcaggcaccttagaggttggtctggcttctgcagaaaccaattcaagtaagtgtttccatttctatgaaaggggctctgaccagacctgcaggaaatggaggatggctctccaaggaagagtggagtctgaagtctcaggatgtgaacttggagggattttttttcccacaagaatccagcaaatgagaggataaccttacagcatccataaggtagaagcctatcaaacgtaaggacaacctgagactaagggtagccagggagagaagatctgagctggaaagggtgaaacaaatggaccaaaagaagctgaccgcaagacagaaagttcagaatcagggaagctgaatatgaatctgactagaagatgctcttgagagatttaaacttttcccatgttttatgtttcccatattgcaaatagtttccattgttaagagagtatgtttgtacagaaattcagcttatgacgaactttgaaattccaccaaagagatcgagggaacgatgggttgttgcttttcaggactacaaatcagcctgtctttgagatctcacactgtctattttgcagtggaatctgcgatgaggctgtgaattgggcagtgaagtcagggcagggctgactgtgctctgggtgccacggataacagggacattccttcagggctggtgatgctgggaggctgaggggagagactcagtatgaagccatctgtgagcctccttggcaatgctatctggaccctggtcatctaatgagccactccaagcagggagttttgccttcaaagttgtatacatggatgcccgtggatggccaaacataggctcaggttgagcagggaccaagatttaggaaggagcaatatgaggctgacctgatgctctgaggtttcagcacaatcttaagggatcatacagggagagaaaggggtcacaaggtgtaattttttcatttgatgctgaatatacctcttcagaccatttttctaccctgtatgtaactactggtatacatttaaccaaagccactgctactaatgatcatttcagtcattgatagtgagaggtgaggccagctagacttcctgggtggagtggggacttcttacaagaggattgtaaaatgcaccaatcagcactctgtaaaacgcaccagtcagtgctctgtaaaatgcaccaatcagcaggattctaaaagtagccaatcgtggggaggattgaaaaaagggcactctgataggacagaagcggaacatgggtggggacaataagggaataaaagctggccaccccagccagcagtggcaacccgcaagggtccctttccatgctatggaagttttgtcctttagctcttcacagtaatccttgctgccgctccgtgccatctttaagagctgtaacactctccacaaaggtccgtggcttcattcttgaagtcagccagactcaccagcaggaaccaactccggacacaatagcctgtgtgcacagatcccgagaagctggaaatctggaccaccattcaatgtatgaggagacatacacataaagttcacgttttcgccatccacaggaggtgactgtggatgtgagtttgagtctgactacaagacggtcttgtgagatttaaactacaatttttcctattgaaaagaagaaacacctttttttaccctttttgcaacaaatatgtattgagccccaacagtcatgcattgtgctaaatgaaaaatttaaagatggcacaaaagaacaaaaaaggaagagaaagagagggggggcttcaaaatcttgtataattcgttgcaaatactatgaacacttccaggtatgtttattcataaggacagtggatgcaactggcagaggctgcagttttgcagtggagggaaactctgtatacagaggcaaacttcttctgccatggccacagcaatcccttgttctaagcttaggaagaaaaatctaaaaaaatgaaagtcacagaaatagcaagtagaatgctggttaccagagactgcattgttaaagggtacaaaatatcagtctgatagggggactaagttttggtgatctgttgcatagcatggcgacattattatatagatgtatttctggcaggcttgattgcctattacatggtaagtcaacatacactaagacactgggggctgctgcagagaaagagatttaatcccaaggcaattaaatgagaagacaggaggaagcctcatatctacctccccaagcactttggggttaaagactttaagtggttttggatggagaggcagattggttgaagagtgaaggatgaagtcatgggactgggaggtgaagaaactgctttcttatgttgactcggttctttgggaggggggtggtctttagacaagttggtgtcagctattctactggaattcaggatctggtaaatatctcaaagattaggttttatgctcataatggtgaaggtgttatatttgggaacaatggggacgttaatggtctgtatttattgcaacttgacttttattagtgagaagctaagggaagtggctcagaatgttgtctgattaatgcttaactatatttcagtctggaacctggaatactgttcttgttaaccttatgacagtggttttgtagttaataatactatattctgtatttcaaaataacaaagtatattcaatgttctcagtacaaaaaatgataaatattggaggtgaggactatgttaattaacctgatttgattattcgacaatgtatacatgtatgcatctcattgtaccccatatgtatatacattactatttgtcaattaaaatcaaaataaaacttttaaaaattcatgtagccattgcctggaataaataaagaaaaatatgtgtgcacatgcttaactatacccctgtaaaaattgaagctactaagtccagtaaaatactgaatcacacatatttctgtctttagctttagtggaaatagtcaaaatactgggtcccaacaatacttatattagtcttttcttcccatatccaccaccttgttattttttaattcatttgtaatacatttagtttcatttactcttgtttgtaacccatttggatcctctcatctttcttgatttcaattattttcaaatatttgtagtataaatagagtctccaaagacataaattcacaaaaacaaaaaggtaagctcagagacgtgtcgccttccaccccttctgtaccactctcatctcatcccttcaccccgttaccagccccttcctcttatcactccctgccagcctcactctgtctatcctctcaaatttgttgttttcgtttacggttctgtttgtttttaaatctcctctgctttcttacttggaaggtaacacggtatagatatttgtttgcactttgctttttttcattcaactgtatatctgagaaataacttcctgtcaattcatagataacttcttccttttgacagttgatacatactccattgcatgaatgttccatagctatttcaacaaaatatttatttatgaatattctgggtggtgtcaacattttacaaatcattacaattaatgttccaatgaataaccttgtgtatatgtaattttgtagtgttgaagatgtatcttcagagattcctaggaatgggattatgggtcaaagttacacattaagatagttttgtagatgttgtcatattctccttcttaaaaaggtagtattagtttccatcctcacagctgttaatgagaaatcctgtttccctataaccttgcctaaaaatacggttaatattttttggattttcttaaaccagataatactacctcaaagtagtttcaatttgcatttccctcattactgagattacacactttacttgtgtttaaatgctatatgtatatatcttttataatgcattgtctgttctcttttcttcttttttctattggatttttgacccattatcttaacttttaatagagttgtttcatattagaacagtaacagtttatttgtttaatatattaagaatagtttctccttgtttttagttgtcttttgattttatttttgtgtatgcaatttcatttatttatttacaatcttttatctaaaaattcaatcatatttggcacaacatattttgtttacagtgttgatttattttatcctaatttgttttttagttctgtattattttattataattgagtaccccagagaactacaacctgcatccttggcttattgtgttttacataatttagcatttgacgagcttccagacctggatcttaagcctcatgatcccccccgcctcggcttcccaaagtgctgggattacaggcgtgagccaccgcgcccggccgaagggacatattttttaatatccttctgttttctctaagaggtttctaattatttttccctttcccaggcatattttacattggtctttaataggctgagttttcataaatattttctattctatatggtatttttacgtattattttaagtgataaaacacccagagggcacaaagggcacacatcttcaaattgtaactgaatagtttttgtgtattcattggccagatggaactacagaatatttaccttctgctgatgcttcctccatgcaccttcctcttcagtaactgcttccccatctcaaccaaggtaattgtcattctgacatcgaacacagtaatttgggtttttatgtctttaatgtcatataaattgaattgtgtgcttttttctagctttattcttattgtttactacttttgagtccttcattataggctgtgggctcaaaatcctgcctgctgtaatcttctgtgattctgaaagatttcatcttgaatttcttataaggcagagctgctattaatgaatttattctgtttatcaaggaatatttttagttctgaagaatattttcaccagaaacaaaattgctggttgtcctctttcatttccttttagtatttaaagatctcattccaatctcttccagcctccctcggtcctaatgaaaacttagccaatggcattattattgtgtctccatatgtagagtcagcttttagtcctgacacattcacgaatttctctttgtctttcaacattttaaagtataatgtattttgttattaatcttgtattatatcctgaaagcgtttcattgagtttctttcatctatagattaaattacctttgtggttcattatttttgaaaagctgttgtcattacttttccaagtattttttgatcactttctctctctctctgctttttttgtgactcgttttacacacttgttggtatctttcaacctgagctgtaattctgtcaagtcttgcgcattttttcttaaactcctttctttatttagattcaataatttctgtacatctatttttaagttcactgaatcttttgccatcttaaactgatgttggacttatgtaatatatttttcagttgagttattgtactttttgtttctagaattctcacttgattcttttccatagtttctattttttaagagtttccatttgctgagtcattgtctttatattttcctctttatatctttaaaactatatgatcgtagttttaagaataattatttaaacatctatataataattgctttgtagtctttgctaaagctgatattcaggacaagtcagaatcagctttcattgactgtgctttcttgctgcagttgttttgttttgttccctcaatattgatcatacttttctgtttctttgcaggattttttaatggaaaactgtatattttagataatatattcctgtacctctatcaggaatatattctatttttcttaaaatttgtgagtttctttatagttacttccctgaacttacagtaagtccctaattcatggtggttgcacttaagatgttttgactttacaatagtgtgaaaattatttgtattcagtagaaacagtgcttccagtactggtacaactactctgtttttcactttcatataatattcaataaaccacattacaataagttataataaattattggtggtgataaatgaaagtgaccagtgaaattccttttggaaggaagcctttgacaaagctaagacagctgttcctatcactcttcctacttggtcattcactaactttcttagttttgttatttattaaaacagagtacctctctgcaaatgaacagctgttactgagtcaattagttggataaatataattttctaccttttaaaatatttgtagaagtcaaatggatagctgcaccatgcactgagctgcgtttactggggagactgagaattattgatgtcatgttaagaatcacactgtgagaaactaattctggaaatctgagattctggtggcacagttgaagagggtttggctacatctgcgtagtgattatttccaaaaataagcacgtttgcaaatttttaaacttctgatctcaccatcaccatactgccacccacactatattccaggtattcaggcactggaagttctcattttggtgtttcttcaggttcactgtggctattctacatccttgacattcccatataatatttagattagcttcttaatttaaattggagtatactttaggattttgatttttcttatatgtaatcaatattttaatctttgaagaattgacatttttatagtactgagacattcagtctttgaactgaatttctatttacttaggttttcttttatttttcaaaataatattctggagacgtcagtgtatttagtctattttttttaaataattgatactttgatgtttttgtaaatggtgtgtttgttttataatgttaatttttagcattttttattatgcagaaatgaaattgatttttgaatctatgaattaataaattgatcttgaatctaatgattttctatttctcatgtcaattttagtagtttctctgtagacaaatttgaattttatctgcacacaatccttcatcagtgaattatgacagctttaattcttcttttccaattttgattatttgttgctattgttgttgccttatggctctggttgggacctttactgacatccactgatgtaaatctgatccagtggccattactgtgaaactgtgcttaaacctggctgtccatcttggtctgaggaaaaatgcaggaatcagagtcaaaaatatatcaagggattacttttttaagatccccaaaatgcccaagcagagaagagatgctaaaattgagttgtcattgcagcagctatctgtaaaggaagcagctggtataatctagtaaacaatgaaggtcttgcagaggtttttgtttcaagctgaatcactgtgggaggtgagctaccatactgctgacagtaatacactgcaaaatcttcaggctccagtctgctgatggtgagagtgaagtctgtcccagacccactgccactgaacctgtctgggatgccagtggccctgctggatgcaccatagatgaggagcctgggagcctggccaggtttctgctggtaccaggctaagtagctgctgctaacactctgactggccctgcaggagagggtggctctttcccctggagacaaagacagggtgcctggagactgcgtcaacacaatttctccggtggtatctgagattggaaataaaacagaaaagtcacccatgtaatctaaatcaaacccattgtcttcccagaagagccagaattattgctttatattgagctttaattattgtattgactgagcagagttgccaggtaacaggacttgagagggttttcactgacatgcaaaaccatcccatgttcccctcacctgggagccagagtagcaggaggaagagaagctgcgctggggtttccatggttccctctgggtcctaactgagcagctcttctccagagctctgacccaggcattgatatgggctctggactgcagggcggctgggagggacatgcaaagcagctggggcgggtgctgggcttgcagctgcagagacaatctgcctcccctttctgctctcagcagcccatgcccaggtgatcaggccagaaaaggccgttggctcagtctgagggtagaacttctcccctgcggccacagaatttaacccctgtgtcctcttgtctcaccatcacctagattgagccacagaatgtttggtacaagtctgttagaaacaaaatagaaggctgtggtttcatttttctctttctgctccaacttgtgcccagtcagctccctaaatgcatgatggatcaggttgaaaggaagagtctattacaactttatcttccggatatacttgtatttacttgttagtgatctttcctgagggtccagaagctgtctcattctttgcagaaattaaaagagtaacattcaattaacctcagcactgtgggtgtgaggactttcacaactgcacagataagtgagacctgggctccaaatcctcagggtagtgataccatttccctaaagacagaagatggttttgtccatgcaggcaaagaactatttcttgggtgatcctctaaactatccagtctttttattctgtatagctggtatagtttacccttagtaggatgaaacaaccacttcagtctgtgacagggtgaggtctgggatgcagatacagtgttttgtcaaattatctgtgttggcttggaagagccttacaaagacatgaagcttctgggtctctgctgcctgatccttgaagaaaaagcagattgacagatcagtgccccacctcccatccaccccaggatctcaggcatcccctactcatccacaggtgttgggctgagttagtggagggactcagtctgtctctccctgttctgagactactacctctttgggcacccattgccattgttgcttgatccagtcctttcaccctcggttgtccagttctagaaggcaggtcaagtactgtagaaaattgacatgtctgataacgtcatccaccctaatggaggaatcagatgaccctcctaccagcagaaggaaattaacaccctgatatttcttgatcctgtggaacccatagaaggcacccaggggaatcattccatccaattagagttaggaggcctgtctgggttatcatggtggcctaaactgcaacacccccaagaacatcactataaaaggaaaaaaatgattggaaacactgagtttgggatttcacagtggcagctctatcaggaaactggccttgcccaacttcttcctcactcaactcagtgtttttcaacctgcacctccgtgccgtctttcccttgctctgcagtgcagtgtttaatgtccaattgctgtagtcagatggggtaccactctactagcaggttgccctgatgtacactcttcagttgccgtgtgagtcagctgttctagcattaaatagatccattggcctttggataacaaggtgtatggaaaatccatcatgtcccatgagagtgtgtccattgacgtcatttgggcagtaaagaactttccttggtcaaagcaaagtctcagtgggcatccaaaaacatggcataagttcatctcaagggtggtcatggtagacccagcatccagctgagtgacatatttgtctcttataggtggcaagctgttgccatagtccttttctccacagaggggatgctttaatagtccagtcactcggttgctattttcctgatcagatagctagactgttggcagtggcccatgagttggtaaaaatatagcaagaggtggcagaaaggcctgcatgaccattaccactgcatgtagtttggaccattgggtggaatgaccattatcagtctcaggaaagaaaatagtcatccactggctagatggtagccacccccagtctacatgttttgcagagccctaagtgaaccatgccataccgatgtcggcatgtctctgaatcttggacttcgggtagccaaaagcagagccaaaccatcccccatgggtcatttagtcccttctagcaagctcgccatttgtttatggagcctttggatcccacgggttgctggctgggcctgattctgaatacaccatttccatttgataatgcagctctattgagcctgtccagtttcactggttggattttaggcacccaagtgaaaaggagcagttcacccagcagcgccacacttggtgctcagccccaagatgtccagtccctgtcagtttcccatagcaagcaaggagttgctatgccaaagagggacatctggtggctgcttcagctggtttgtgttcagtatctgagaggctggctcactcagtgacaattttctgttgccacatactacagtcagcatacatagagactgtggacacctgaacttccatcaggctaacaggctctaaaggtctaaaagaagtgtttggaccatgtcctgttgaacttcttccaaggctgctgttgcaaagggctctgttcaaggttggtggttttgtttgtgattttgattttgactaaggggactgaaagcccaccccagagaggtttatgctgttaccaatactcaaagaagcctaccagctgttgtcctttattaatggttgctgctagtaccaacaatgtttaactatatctgctatccttccttggtttcctgtccaagtggccttagcattcaacgtgaaatagtccatcgttagtctctgttcccctaaagtctttttgccccgccaaactgagttgctccatggtgacaggggactatgtaacattttaatctatttgtagcaagtcttgaaaaaaacaggtaatgtcttattcttcacttagtacacagtactgtttttgtcaaataacccacggagtcatgcgtagcttaggtcgtaggcttcagtggatattcccttttgttaaggcttgaattcttagctgcgagggaatataccttttatgcagcagtgatgttctgtggtgcaaatatcaatgcctgtactgcactctgaggtgggaactacagtcaccagccccaacatggcccacagggcaccatccacaagcagagaagcaccatggccactgcatttgtccctgaacctctcaatgtcattggttaaattttccccaatggagacctatgggctctggcacccaaaaacccagaaaagtatttccttattttctccttttatttttacatggtctagggccactggtttctggtgagcacccaaaggcattggctgtatccctaacagtgacatttagatcaagaaatttggaactgcaaatattgctttatcaaacaaatataccaaacagtctgcataagacttccctgaactttttctgtatctcttatttagagagtgagtctccctttgtgtgaaagcccaaatagcatatgttggttccctctcagggatcttagggtccatttgagtacccgtttccctagctctctggctccaggaatgagcaattatgcaagtgtctatgaaccagaggattttgtgcctcattctcatttctacactcctttctctctgccttaattcaggcagccagctcatctaaactcatgcagagagtgatctataacccactgatcctccctcattccccataaagcacccagatgcatgtccaggccttgcaccttccagtctaatggtcctcccctggccaagtaatgggaggtatcattcttcccacttcaccaataagccatggttctgtcatactagaatcttctcaatggggcaattttgttaagcaggttaactgtgcagtgattaccaacttatttgagtccagggagattaaacacccttacacaactagttatgtgaagcaatttacaatttacagacaggcagcaagggatagcaaaatccaagaatttattgtaggtctgttcccccaaggctcaggaaagctgcctggggctgatggggtctagactgcttcatatatactgcagctgaggcactctggattggacccaccctgggttttatatcttggagtcacatatcatgctgagctaaagtgttgaaggaaatcttgtttcaagagggtatggcaggacaatactccctgtcaattggacagacaggtctgcatgacagtcacacagacaggcctgtgtagcagtccagttacaccaacaaatttccacagcgctgccttaacactgagcaaataattaaacctaggggaatcggttcccaggcatcaaagctagaagtaaaacataggtcagtgggaggcttgcacaggcttctccctaacctcgagcaagtcaaaataatggagacagccttacattcctagtgccaggacccgtcttgggtcaataaaatgagatgagtcaaggtaacagaggcagctgtttgaatagattcactggagagtctaaggcagctctctggaccaagctgtaaatgagataagatagaaataatcactccggtaccacagtcctcactgattagaatttaggagacagggcttgaaggtactggggccctcacagcttaatcggaattagcatttctttggcctctgacctagttgaaacaaaattagttgcctatagacttaggcaaatgttttactgcacgtaggcacataaagccaacctatataagcactaagaaaattgtaacactttcagcctggccaacatgctgaaaccccgcctctactaaaactacaaaaattagccaggtgtgatggtgggcgcctgtagccccagctactcaggagactgaggtaggagaatcgcttgaacctgggaggcagaggttgcagtgagctgagatcatgctactgcactccaacctgggtaacagagtgagacttcatcaaagaaagaaagaaagagagagagagagagagagaaggaaagaaagaaaagaaagaaggaaggaaggaaggaaagaaggaagaaaggaaggaaggaaggagggaaggaaaattataacacttgcagttggtctggtgatattatctctgaccttcttcctgtatccagttacaataataaattcccttctttcctagtttctctgcttctagttattgggccgtgagaacatgcagccagaactcggcacaaggggattggaacagagcctgtgctgtggtggccaatactgccctatctcaggatgttacattcccaggatattctacagtgattcttgaaaactaagagtgagaaaggggaggagactgggttggtccaaagccaactggagactgtgctgcaaatactgcagtgggatcacacttcattagtcctgtggcttgctgattttgctgagcatagtgccttcactgttcatctatgtgggagcctgtgtcagaatttccttcctttggaaagttgaataacattccattgcatatatatttatatgccacattttgtttatccacccttccctgcatgaacatttgagttgattccaccttttggctattatgaacaataattctctgaatgtgggtatataaatatttcttcaagttaatgttgtcagttatttggatatatgtccaatggtggaattgctgaattatatagtatttctatttttaatttattgaggaattgcaatgtagtttcttatactaggtgaccattttacatccccaaaacagtgtccacaagatttccaatttctccaaattctcatgaacagttttcattttctgttgagggaaaccatcctaataggtataaggtagattttgttttcattgccctaagaattagtgatgtggagcatctttttctgtgtttattggctcttcatcagtctttactggagacggttaatattgagtgtcaagttgattggattgaaagaggcaaagtattgttcctgggtgtgtctgtgaaggtgttgccaaaggagattaacatttgagtcagtggtctgggaaaggcagacccaccctcaatctgggtgggcaccatctaatcagctgccagtgcagctaggataaaagcagaaagcaggcagaggaatgtggaaggactaggctggctaagtcttctgaccttcatctttctcccgtgctggatgcttcctgccctcaaacatcagactccaagttcttcagcttttggactcttggacttacgctggtggtttgccagggtattgtcagccttcagccacaaactaaaggctgcactgtcggcttccttacttttgaggttttgagacccgaactggtttcctttctcctcagcttgcagacaacctattgtgggacttcaccttgtgactgtgtgagtcaacattccttaataaactccctttcatttatacatctatcctattagtcctttccctctagagaaccctaatacaggaatggtcaggaagcaattaatttccctttactaatctattttagattgtctttgtgcaatgaattttttctgggttagtaaattaaaggagcctctaaaactagctacacattgtgaagtccacattagaggcagtggaataagtgtcccccagcatttaaaacccaaagatttgagggccctgaatctaagattttttctagctctcttgcttcataaatatgccctctgatttttaattctaccttagagaaggacaattgtggggaagatattaattgtgggtgaaatgaagaatgcccacatcctgtccatgtcctagtacctagaacctatgaattctaacttacgtagcaaaaaaaaaaaaaaaaaaaaaaaaaaaaatcccaaaacttagtggatgcaacttacttaaggattaaggattttgagtttgggagaacctcctagatcatccagatgagatcaatataatcacaaaggtccttataattgggagggaggagggtggcagttagataggagctgggacaatggagagggatgctggagtgatggaagaacgggtcatggagccaggaatgttcgggcatcttttttttgttttttttgtttttttttttgagacagagtctcactctgtcgcccaggctggagtgcagtggtgcaatctgggctcactgcaagctccgcctcccgggttcacgccattctcctgcctcagcctcccaagtagctgggactacaggtgcccaccacaacgcctggctaattttttatatttttagtagagatggggtttcactgcgttagccaggatggtctcgatctcctgacctcatgatccgcccgcctcggcctcctaaagtgctggggttacaggcgtgagccaccgcgcccggcctaggcatcttgaagattaaaaaggaaagaatcagattctctctcctagagcctctagaaggaatagagccctatgtctccttgatattagctcagttagacttctcatctccagaaccataagataataaatttgttagaagccagaaatattgtggcaatttaaccagtagcaattggaaactaatgcaaggggaaaaatgtcttttacgtctctgagtgtgtggtgtcctctgttctcccaaacattccatgttgttataatctggtgccagttttgacaagagatgtaaaccattttctatgagaacttgcaccgggattcttcttaggtagaaaatgtctagagtaaaccctttgattagctcttttccaatgtgtgttggagagttaagggatcaggtctcatagcacctgatagaaagaggagggtttgtttgtttgtgtgtttgttttcatgtttggcaggaaagttagaacacaacctgacaaggaaagac

SEQ ID NO: 825 - DNA, 148670 bp, Homo sapiens
aaatacgggctgaattttaaaagacataaattgtgcttggtagttatctcctgggattgcagaggaggaacaatgacactttatgccatctcctcctactcttctgtatggtgatgtgaatatattcattttatagtttttagaaataataaaactgtactaattttgaaaaacagtaaactctgacattgcctattagcattctcgatattcctgtgcaatgcataaacataactttttaaaagatatgtacacacatgtgtgagttttctttgtcaaatacttttctataatctttaaatcaagcatgccaaaaaggtaaaagctttcctgtttcagtgtaggagatagtcgtctgcaaaggaaagagatgtaggggatagaaacaggaatgaaaaagatgactgagctgttcgagggacttatgttcctaagtgagctaattggaaatctaatatgaacagtgcaaccgaataactattgtaaagcagtatttgtaaacaataaaagatgattatcataagtaccattgttgcaaaaactattttattgatcacatgcagtggtgatctgtaggaatgattgttgtgatgtttgctgtaacataaaatgaaacatgggaagtggctgagatctttaggatgtgtgtggttcattttttgaaagcaaatgttgtctcagaagcatctgtgagactctgccaggatccaccgttctacaaaatatctgtgatggacattgataagattgatctgttgaggaaaggcaaggtgtcagtaagatagtctgagagcttcttggatttcatgtaaaagagtgctggaaatagaatttcttggggaacattccaactaactcatcactgaaggtgctttacattgaaccctcagcaaagttagattatcagaaaaaaaatataaactgctgtggaggggacaggaaggaaagtcagggagggaggggggcaaggagagaaagagcgagagagaggagagaaagagagagagagaggagagagagagcacaagtacacacttcaatgcacatctataaatcatcctgaaaactactgataaattattttagcaatgttcctcagatgtaacatttcaagaaatatcatttttgctttttatttggcataatttactagccaatttaggaagttcccctcacatcagtaacatacagtacatcacccagtatgtcagaggacacaatggcataagtttgccttttgcaaggtttgagggatggccatttccctacctgactcaggaaagtctgtagctgatatccatcttcaagtttgtggttctttctctctatatatatatttgagctcagcagtcatgctggagtccagagtaggtgattctttctgctttagcttgactcctccttaagattgtaactctctcagttttacattttttgtcagacgtaagctgacattccacaaggagaggaggaaattctgtggttcacatccagtggtgcttggaacctgattggttgtcattcttccagctagtttgtcacgagtggatatctgtcctggattcccaaggatcaaggctgccccattagccaggaagtagggagatagaggaggtcacttgagaaagagctgcttctttgccgcctccaggttgtgtctgtttcctctcatatctgaagacagatgtgctggcagaagcaaagtcctttgtccggccacgtgcaaatgcatgggacataaatatgaacagagattcttgtcccactctagaaaatgtagatgttcatcttgtttccaaggggacagtaaggctgcaggtgttttttgacttccttgagagaaagagaagatagcagcaattgtatcagggcttactatcctaggaggggttcagccaccgagatttacatattcagtgctgtggtttttgtttcattttgcaagaggaacgagcccctcaagctctgtcttagagttccctgccctccctgtctacctacttggcacccagcccctatgttctcttctcgtattaaggcatagaaatcatgggcaactactgttcaggctggctctggatgaagttgtgaaatcgatgagttggggcttagttttgcagacccccaaatgccctgataatcctggctcgaaggggtgtccagcccctccacacctgtgggtatttctcgtcaggtgggacgagagactgagaaaagaaataagacacagagacaaagtatagagaaggaacagtgggcccaagggaccgtcactcagcatacggaggacccgcgctggcaccggtctctgagttccctcagtatttattgattactattttcactacctcagcaaggggaatgcggcaggagaacagggtgatagtagggagaaggtcagcaagaaaacatgtgagcaaaggaatctgtgtcacaagtaaattcaagggaaggtactatgcctggatgtgcacgtaggccagatttatgcttctctcacccaaacatctcagtgtagtaaagaacaacagagcagcattgccgccagcatatctcgcctccagccacagagcggttttctcctatctcagaatagaacgaatgtacaatcaggttttacactgagacatgccgttcccaggggcatgcaggagacagagggcttcctcttatctcaaccgcaagaggccttcctcttttactaatcctcctcagcgcagacccttcacgggtgtcaggctgggggacggtcagatctttcccatcccgcaaggccatatctcaggctgtctcagtggggagaaaccttggacaatacccagttttcctgggcagaggtccctgcggctttccgcagtgcactgtgcccctagttaatcgagaatggagaatggcgatgacttttaccaagcatactgcctgtaaacatgttgttaacaaggcacattctgcacagccctagatcccttaaatcttgattccatacaacacatgtttctgtgagcacaaggttggggctaaagttacagattaacagcatctcaaggcaaaacaattgttcaggatacagatcaaaatggagtttcttatgtcttccttttctacatagacaaagtaacagtctgatctctcttttccctatcctggctgaggctagagctccaagtctaagaaggaggataggaggcggacaggccaatggaaacaatgaatgaacaacagatggaaacaaggaatagtgtggatttttgagttcattagcgcgtcctccactctttcaaaacctcctttgcaatgacagaagaaatataaaaatgataatgaatttatttcgtggttggagaatcatgagaggtcctattagaagaaaaaactttgaagaacaccacagagatttaaaccatgtcattgaattcatagagaaactggaatttagaaacattttttccattgcaaaaacaggaggtgtccttgaagcagccagttctagttttccccacagagccccagaaaagccgtacttcagagctatcgggctgggaatggtgataggtggacagtggagagtggaataacacctgggtcatctctctgctggttacagacagcttggccctcatgcttcaggccgtgggaatagagattgaaagaaaaagggggcaagttaataggcattcaatagtaatgggatttaaaaaaccctcccaaaccactagaaggaaaagaaatagacaaaaataataaaccaatccagcaaagtttaggaaaagtgaataaaaaattgaggtaagcacgatacataaaagtacaaattaagtttgaaggaccaagtcaaaatatacagtcacaaactattgtgaatgttaaattatttaaaactttaaataatttatctaaaaataaaaataaaccaaaaagatgactatgtatgttttcaaggatatttgattcactagagaaacagttcatttgcttcctatttatgatgattaaaaactagattgcaaaagttagatgttaatgtaaagaaaactttatgaaaatgataatggatttttatctagtagaaaagataaccccaatgcttatggttttattgctctgtaggacattaacaagttgtgcatcttatttagcaaacttattctaacattagtagatgtgagtgtgtgtgtgtgcgtgtgtgtgtgtgtacgtatacatataggtgtgtgcaggtatgtgtatatgtatgtatgtaggtatatatgtatatactagcaaatgataaagttggttcaaaggacgatgtacagtagtacctccttatccacaattttgctttctggggtttcagttacctgtaggcaactgtagtctgaaaatattaaaaagaaatttctagaaataagaatttactcattttaaattgtgtgccttagtagcgtgatgacatatcatgcccttccgctccataccagcctgggactgaatcatccctttgtccagcgtctccatgctgtctacacttaccctcctgtttagatgcttagtagccctcttggtcatcagattgactgtcatgatatcctagtgtttgtgctcaagtaactcttattttactgaattgttctattttattactagttattgttgttaacctcttactgtgactaattaatgcattttatcataggtaagtgtgtataggaaaaaacatagcatatgtagggttgtgcaatagcatccactggggggagaattttgctgaagttagaacagagaagactgtccagaagaaagaattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggccaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttatttatttatttgggtttgggtaaaacttaaccatatgtttaacaggacctggactttgatttaagcaaacttagggtaaagacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacaccacgttttctttatccaatcatctgttgatggacacttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacttggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaattttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggttcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataatgagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagcgaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagcggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagtgtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactattttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttgtctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttacgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctcatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactacccaattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataaaaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcatcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggtgctcattgatagaatgtctctaagtatcaggatgaacttgaaacagttccagggttatttggctgtggttgcaaggctgatttccctcagcttgtatttcactgtagctggtatttctgggcacttggctctacagctgccattaaatggcactaaatgatgccccagtgaataagctagctgtaatgtgtgcttcgtaaacaaggagaaaattagagttcacgggaagaggaatgcatattccattccattgtatctaatgcatgtcgttgtctttgaagggaggaaggccttggtaggcctctttggattctagaggcaagaaattctgtaccttggaatactgtactggctcactgaccgactgatacacgagtcagccagccttgagtgggacccggggcaaaaaaagggctctgcagcaggttcagcctgtagcacaagcagtcctgcctctcaggccagtgcagatgcagatgaattggacagcacaatcaaccatctggacataattgacacttcgagaacactccaccagcacagcagattgcataatcttttcaaaaaatttactaaaatagaccatattgttaccagaaaaggggattttgattcaaactccaagagaggattcttggatttcatgcaggaagaaattcaaggaaagttggaaagtgcagtgataagagagaatttattgaaaattactccattacagagtaaggcatcctcagaaagcaagcagaggaacataccgtctttaagtttttcttatataggagtgtcgtctatgtaaagactaaactaagctgtgcctacatgcggatgagcagacattacgacaaaatttattattctgttgatttaagggaaactattcttgacattctagtgtgttatcttggaaataaggactgtgtcttgcaaagaaacatattcattggggcaatgtgttatcaaaaaaaagattttatctacttatgatccaataatttagactgacttcaacagatttttttaatgacaaaaagcagaagatggtataagaggaaaatacaatacaacagaaaacacaagctattataactcttgcttcatggatttttacatatctattagacatatgctgggtatatgtgtgcaatgataatctaaaaactggatgctaactagcttaaggaatgcctgcattacactgagtcttgcccacttttccaattataaacagaaagctacagtactatttgtatgagtatcaaaacttttagctgcctgagatagaggtaaagaagatttactgagataaaagccttggaagtagtagagatttgtcctatgatgttatggctgttgctgtggttgccgttgttaggaaatacagtgggagtgaaagcaagattgacaagctctgctcttcctcatactcacaaccccctctagagatggacagatggtggtacaggaatctctgacacctcttagaagtcttttgctctttccagaatgtttcctgacaagtattgttttgagtcacagattaggtgaaactgggtgtagaagaaaggactagagcaagggaagaagttttccatcccagatagttgttgtaggaacagggaaatggaatttttcatagatttatgccacatttctatcatgttggggagagaggcatcaaaccaggctcattcctgaaagaatcattacattattttagagagaaagaactacaaatttcttgtcaaatagatgtttaaaattcaaagctactgatttttttttttttttttttgagatagagtctcgctctgtcatctgggatggagtgcagtggcacgatcttggctcaccacaacctctgtctctctgattgaagcaattctcctgcctcagcctcccaagtagctgggattacaggtgcaggccaacatacctggctaattttcgtatttttagtagagacggggttttgccatattggccaggctggtctgaaactcctgacctcaggtgatctgtctgcctcagcctcccaaagtgttgggattacaggcttgagccactgcaccaggccctgctgatgtattaatattattcatcttcttgaatacaccaaatggtaaagtgcaaatccacactttaaacttgagatttctactcctatgtaaattatactagtgaggaacaaaaaaattctctattggttgggagatgatgtttgacagtggtcagtttgtgaagtggaggcttacgtcacagtactttttacagtattgcatataaacatgaatgtcctcatacccagaagaatcagcatttctcatgagccatattaccaccaagaaagaagtgaattgaagcctgtgactacttgatgaagggtgtatagaagagggaaagaaaaaggacacaaaacacaatattgtaagtggaaaggagaaagtcattacacagcctataagagtaaaaaaataaagagaggatattatgagtaattttatgtcaactgacttgacaaaagtggtgcagggcaggttcttggcttcactaggaaggaatgcagcgtaagctggtggtagaagaaaacagctttactgaggtggcagtgttacacctctgtgactgctcttgtggagcagagctaccccataggcagtgtgccaagagcagtagcatagggcagttttgcagtcatatttatcactgcttttaatgacgtgctaattaaggagtgggttattcagaaataactagaaaatgggcagtaactttcaggttttgccatggcaatggtaaactgatacggcactggtgggcatgtgttatggacaggtgcttccagtgtctcttccttgtgtcacccactcttcaatctggtccagagttgagtcccacctacctcctacctcattgccccttggagattagatactcctccttaatcttaaggggactgcagaagagcagagtcccttttctgtgagtgcttccttctgactttatgggggcaggccttccctagcatttgaagagtaaaaatctttggtatctgaactaaggggcccagtggcaggatgctttcatttgtggggtcagaagacagaatggattgaaagacttatgacggaccgtatcatttttacatgaaatttagaagatataaactttactaggaggttaaacaagaaaattataattggaagagagagaaaaattaatgctcctatgtccacccacagaaccaagttgttaatctatgtgtttgcaaaacaacagccttaagttttctaggttttataaatggaggttgtggtgtccaccttttgtgcctgcaggatctcataagaaacaggtttaatcctggacagctagtggcttcctgaagcctaacagtagttggaataattaagaatatctggtaagggcccctttattctgattattattgattcttgggggatcattttgttgttgttgttttttaagacagagtctcgctctgttgcccaggctggagtgcagtgacacaatctcggctgggctcactgcaacctctgcctcctggtttcaagctattttcatgcctcagccttctgagtggctgggattacaggcatgtacccccatgcctaggtaattttttgtaattttagtagagatatggttttgctatgttggcaaggctggttttgaactcctggcctcaagtgatccacccacctcagtctcccaaagtgctgagattataggcgtgagccactgcacccagccagttccttctttttaagtttttcataagactaagtcttttggttaaacagaggagctattattttgttttgtggaaaagggcactattttattttcataattttaaaagcccttttgaatctggcctacatttcaaacaggggtggagcaaggtgtgtctgactccctgtttcccaccatggcttgagttagattttttttaggtttctttggtagttcctttggccacagagcttggaatgaaaacatttatagccaattaaatattttaggccagacagcatggaggtgggcaggcactcattagcccttaagcaggcagatcatgaggtcaggagatacaggccatcctggctaacatggtgaaaccccatctctactaaaaataaaaaaaattagctgggcatggtggcatgtgtctgtagtcccagctactcgggaggctgaggcaggagaatcccttgaacccaggaggcaggggttgcagtgagccgaggtcgcaccactgcactgcagcttgggtgacagagtgagactccatctcaaagaagaatatatgtatttttaaagctgtataaaaataaaaaagtaaggccccaaataaggttatatatgttaaaaaaccaagtacgtagaataatactatactgggggaaaacattgcttccagagacgcctaagacaaaacactttagcatcaagtccgcaacaacagtcagaaccggaggtgaaaaagccacaggagctgatgaagaagcaaaaggagacagcaatgatctcaggcctttttaaagggagaataagctgaaagcagcaaaacaccacagttgaatctctaagacactaatctcagaagttttaaaagaaactcattattgcatcaaaggcaaaattttctgttttactttttgtttgtttgtttttcgagatagtctcactctgtcactcaggctgcagtgcaatagcacaatcttggctcaccacaagttctgcctcccgggttccagccattctcctgcctcagcctcccaagttgctaggattacaggtacgtaccactgtgcctagctaatttttgtatttttagtagagatggggttttaccatgttggccaggctggtcttgtactcctgacctcaaatggtccacccgcctcagcctcccaaagtgccgggattacaggcatgagccactgcacctggcctgtataattttcaataatgtagcaaattaataacttaagaaaacccagtttcaatatgcagacgattttctagaaagtgactgggccatcattgttctcatctcagatttccacttcctgtatagaaggtgtaagaagaggtagcaagacattatgaaactaaattgtaagcatttgttagtgaacaaaatatgactaaagcgctactttttttaaaaaatttttatttattgttattattttttgatacagggtgtcactcttttaccaggctggagtgtagttgtgccatcttggctcactgcaaccttcgcctcctgggtttaagcaattctcatgcctcagcctcccaagtagctggaattacaggcatgcatcactatgtccagtctatttttagtagagacaacacttcacagtgttggctaggttggtcttgaactcctgacctcaaatgatctacccacctcggcctcccaaagtgttgggattacaggcgtgagccaccatgcccggccttaaagcagtatttttattaaataaagtgtagaagaaaaagtgtaaataaagtgacaaaaagaaaacacaaggccgttatggaaaatgataactttagggaagaaaacaagaaaaggcaaaccaagattcccatagggtgagtctccaatccacaatcctcagacaaatgtcaatgctggaaaccctggagcatccagggagtgaccgaaaataccaaatgctgaaaacccagagtacccgcgtatcagcctatgagtgtcccacaccaaatgccaggaaaccctggagtatccaggggctgaccagtgcagaaaatcctggagcctcagtggggtggccaacagtgagccccaaaggcctggttggggccacagaacaatgtgactctggcttcttagagtcaacagaacaggagaattcttacatccaagtgtcctgccttaaacaattgcacaaacataattagtagggacccaaagaaaaaactgcaaagcaaacacatatatcagggtagaaaataagataaattggctaatggatagataaaatggcattagaggagaaatgactaagagaaggagcaatgaggatgtagtcaggtgtgctatgggggacttcaaatggactatttagccaaaggccttatttcctggatcatctgacatagggcaggtgggtagatgggacacttacaggtgtgcaggagccaaaatggtgccaagcagtgtctaacgtggggcctgtgtgaagatctctccaggccccccagcttgggtgggttgagctcccgtgggtgaactggtgcatgcagcagctggcctgcatgaagcagtggctctgtggccacttacctaactgctcagctccaccgcctgtcaggaaagatgatggctcttaaaacagcctttggctagtgttaacagctctgcaatgttagcaactctgtagctttgctcgctgtagtgctgatccccatcacaccctctctcactgatcactgtcttgccacttctccaatagctgtcttgcccattgctgatcgctatgtccatcttctcacaaaatgccatctcttgctgtctcttgctgtcttgcttctccgctgtttccactgactcactggcacatcaaacgctgcctctcaccatgtcacatttatcctccctcctcattaaacatccatcttcatgtccagcccttgcatcaccaggctgatgtctctgtactgggccaggtactggagagtattgttcctccatcttcaccattaagccatggttctctcaaatcaaaccttctcactgcaccaattttgccaagaaggtttgctgtgcactggttgccaacttacccaaatccggtgacacacagcacccatgcacaaccagttacatgaagtggattactacttacagagagtcagccagagagagcacaaagctgcggggacctgattgacactagactgtgtgtaccccacaaggactgcagctgagggaccctggaatacagcccaccctgggttttatgtcttagaatcacatgacacactgggctagagtgttgaaggaattcctgtttctagtagggacagaaacggaacccaggctgttctggccaatcatgccctatctcagaatgttacatttccagaacattctacagttattccagaaaactacaatcaagaaagggaaggggactgggttgattcaagacaaaatgaaaactattctgcaaataccatagtgaaatcacagctcagtaatctttttgtgactggcttatttcatttagcgtaatgtcctctagtttcatccatgttatagcatgtgtgagaatttccctttttaaagctaaataatatgctattgtatgtatatatcacatttggattaccagttcactcctttgtgaacatttgagttgctctacctgttggctactatgaataattcggttctgaatgtgggtatacaaatatctcctcaagttaatgtcttcaattacttgggtatatgtccaaaagtggaattgctggattatatagtatttccattattaattcttcgaggaattgccatctggtttcccacagcaggtgggccatttacatcaccacgacagtgtccacaggagttccagttccctaagttctcaccatgactggtcattttctgttggaaaaaaaaatcctaataggtgtgaggtgggttttgtttttatttttctaaggattaataatattaagcatcttttcctatgctagttatctaattatctctaaagaatattctccagagaaatgtcgattcatatacttttctcgtttttaatcaggtattttattttaatgttgacatgtaggacttatttttatgtactagatattattaaccccttatcagatatacgatttacaaatattttcttctattccacatgttgcattttcactgtgttggttatgtcttttgatgcccattttacatttttatgtagtccaatttatcttcttttctacttttgcctgtattatggtattaaaggtgttagtattcaaatgtctataaatactgacttactatgctgagaaggtcactctagaccatctctctgatggtggagctaagaattttacactctctcattttgtaccagggcacagtgcagctaggtgagaacacagtggctttctcgagcttatttgtcttgcatttttggcgacaaggattgttgttcacattggcctcctctggcaggtccacctggaaagcattatatttagcaagaaaaaaggaggctgtgaatgatgtcaactgtgtatattccctgttgcaagtgtcaaatccatgaagcataaaaggatttactagaggatattaaattccttgcaaagtgttgaaaaacctgaaggaataggctccaggcaaagcctctagaacaattccaagaatggcactgctggcgcaggctggggaggagctcctgctgcctgagactccacattcaagctgtctcctgcaggaaagagagcagctcttctcactactgccccctgaaggacagcagctctgctatcaactactagagacctgacccctttccctgcagccctgcctgtgttgattatatcttcatgtcagactcatgtagattcatctgttttcaagggtacaggggttatttctgcccaagtccacactgtggctttctatcataaatacacgtttctacacttgaatttccaggaattactagtatcaacagcaaaatgctacaacccaacataaagatttcctttacaaagaacatcatgctccccatgtagcattgtgctccccaaaatgtggggaaactccaatctgttcatcccaacaccatctaggaaaaaatgttcttctctcatgagccattaatctgtctacttattgtttaatttttggcctaaattgtaaaggtggctaaaaatagcactttgaatttttttaaagaaagggtatatagaaaatattaaattatttaaaatacatatatgcatgacacatttagttattgtcaccagcttctttcacatttattttattctgtagtttctggcaatactttctctatggtagagtctggaaatgctactcctcatgtccttggcttcctaagtcccagatgtggtgaagaatgcacatcagctgtgttactacagaatgcttttggattgagatgggggaggggacgtgcttgatctcactcaaatgtgctcaatttcctggtctgggtcacagccaggcagcccagtcctatgggcacaatatcttcactcgccaggtttctatcaaaatgagagtgtccttcttgactgtggaaaacacggggcagggagaggatcaagaaatagcaaaaggagtatttggacttgcctgagctgccactctggtttccccaaatgttttcattccatttcattcatgataataaacacctttctgcctaaccagccataatcacttttcttagatccagctgattcagtgataaaactaaagggaaaaaataaatacagttttcaacgtttaagctgaccaggtggctgtctctggtgtttatacctccatatcccactatgcatttcatcttccctttgcctcactggagatccaagtgcagggaatgcttcacgtgactgtgatccctagaacttcatcttcatgactgttgaaatcttctctgagttttaccagtggaaatggcaataaatagaaagattccagaaggtcccctagggtccatattttctgtacttcttctctaaaataagtaaaatcaattccatttgctcttgctttatattggctacatctatgtgcccaggacacaccctaaagccctgtgttgacaacttatccagtattgtattaagtctaaatggtcacatgcttatcatatcatttcttccaatttcatggaataattgtcatgtcaactctttggattaagaaccatcaaccagataaccacagccctgaataaatagaaacagaatatttcaagctgttcagttggcataacagtgatgagtctatagctcattttcaagatataaatattctatttatgggagtaaaagcacgaatcatggttagtgtttcagagcctccaccacatctgacagcatagcaattcaacagcacaaggtttgtgtgccagctgtgcctgactaataatgtttttttcccctgtctatagggaaatctgcacctgtgcacatgacaagagcatgagctacacttttttcactttttctgaggtaaatacattgcttgatccaaaaccgtattatggaataatttcctgactctgatgaaagcatttggaaaatcctcaaataatatttgtgcagaaatacaaccaaaaagaaaggcaaattcatatataggaaaataaccagtgctctcctcatgttacatgaggtccactagtatcacctgaccccagctgttcatctgatccctgatgtgttgtacaatgttaggggttcaggaggggtcattcttcttggcaaatgaggtgttcagaagagccagtagccctttaagtctcagttagttgaaattcataattgagtccccaaagggacctccataacattggttcatgagactccctggtaaagctgggaaaggtgactgactgaagtccatgtgttgaatcatcctcattattaaaagcccctgctcattaatagcattttgattaatattcactgggaaagcattttttttttattttggctcatctttgaaaagtctagtcatagcttttcaatcactttgtctgcaatcgttttgttgcatttctttgaaggcctgatgatctgtcaaaaccaacagccaatattattacattgccgttatgttgggaaaagctgaatgttgggagaagctgaggcagggcttgcatgtctgacgtaatgtaaaagagtcttggaacacgtccggggtccagggtctaaaaccccttgtggcctttagtacaccaagctctgtgctaaagggtggaaggctaccctgacgcaccataatctaagcccagggcataaaatcccttgtgacttggatagaatccaggactcgtggctctggagtgtgtctacacttgctggctcctttctctttgctctccaaggatcgattgtatcttgagttaaaagaacctgctctccattatctcaagtagtagagcaaatgctaaaccatcacaggtgtaaatcatgtgcttaatgcaatgcatccttttggcctccacattcttaccacgtgtttctttgttggattaccaataaatagcatgggatcccagggctcagggccttcttagcctccatacactacgatggtccctggtgcccacatttctctctcaaactgtctttttctcaatctttgactccaccagactttgtcacccccacgacctggtgttgggtctgatcaccccaaaactgttatcgttgcaatgtgatcatcagatataacccttgcagtttactcattgttatgatttttacatttgcagggcttccttgacaatggcactaatgtgacgccatccagcatccattattgtgagaactctatttggaatatcaccattgtgggcatgaacagaatggagactttcataggatgcaatgtttaatattcaacattagtcaaaatttgttctagtcctacccttggagctccattgagttggaaaaatataaataaatttattttaaatataatataaatgtaaatataaacaaatttaaatataatataaatataatataaatatacataaatttaaacataatataaatataaatataaataaataaataaacaaaaaaattttctgtagcaagagtaagaactacatgtggtccagaataccattattttatggaaggttacaaaaaattttaaatgtatttaattcagataagaattttataaatatgcatatattgcatatatgatagaataaatgtacttaaatatgaatactatatatatttgtagccaacattttatcaaaaacatatatattcacttctatgtatcttatatacatgtatgcatacttttccgtaagataaattttaattttttattgaaatactaattagttttaattttgtctttaattttcttttaataacttcataatttgattactggatattcacatttaaatcaccaatttaagaaaaaatacatgtgtgtacatataggtagaggtgtaaatactgtatcaggaagcttttatgcattactgattggtaactggttaaatacacaactcagtgactgataacagtaaacatttgttttcatgttcacggatgctcatgttcacaatcctctgactgatcaaggaagggctcagctgagtggatcctctgaaggacacagacctcatcttcagcctatagatatcaattgtctgaggactaagctgaacaccagtgactacacatgatacaagattcttgtggcaggtcacaggagtgaacatcccaaaccaaactggacagttgaatttaagtccaataatttctaacatagcttcagatatttaaaatatattcctttatttcagtgagtacaaattttcaagaaaatgtttactccatttaattatagaggtgtttgatcattccatggacaaataattatgttttcatcctttacaatcttgaaaatatttgcaaatgtaaatttgcattaataagaaaataaagctggatgtgttttcaacatgtggctttaaatataattttttaaaatggcctcattgggggaaaatcattttaacttatatgaatatccttttttgcctctcttgtgttctatagagtggcccaataagaggtcctcccatgagatttggaatcaggaaaggatggctcaatattctccattggtacctaggacagacacagggacagagatgaggactggagaaacacctggaaagatgctgtaggaagctgagagcatcagcacccccacccctaagcttccagacaggactgaggaccacatggttagatagcccatacttcaggggaagatgcattcagttttctgagggagcaacagagattcctgcttctaatatcaactttcctgactactatatccttggctttgaaaggttgtagtgggaaagttaatcgtaggaattgggtcattcttgtcatacccaacagagccaagaaaccaggagggaaagacactcagggtgcaaaatattgtctgaagaatgtaattgaaataggccctattatcccatggaactaatgtttatggttttttgaaggaacatagaaattgactcctccagtcttaaaaactcaagatagttatatttttcttatctgaggagttcttttgtcaggaaaccaaccatcaggcctccagatactatcaaaaggagctgaaacttacatatcactgaatcgggacagtgagacatcagactcttcacccattgtgattgcctaactgacctcctgcttcctgttgaccaaatcatcttccttacccctccctaattcctgttttcccacatttcttccctgatatatatacccctcattttagtagttcagggagatacatttgagaatggtgtcccatctcctcggctgcagcacctgattaaagcctgttccttggcaatacttgtcttagtgattgtttttctgtgtggtgagcagcaggatctacactgaatccctggcatttcagtaacaaaattctctgcaagcttcactgcctttggcttattgtaacctgaaatcaaatttatccacaacttctgatataacttgatataactgtaggattcactttgtccaccactgcttcccagtctgagcttgccagctcccaacccttcctagtgcccatgaactttctcaaagagccataggtaacatgttccctttttcgtaaaactctaaccttctctttgttcttccaacatattgaagaccactgagttttcctgtatgccccatttggcaaatatttctttgcacgtaaaacattaaatttagagattcatctctacattttatttagacttcagtagtttagactctaattgtctgtattaagacaattcctgctttgaatatctatagtggcctcttctctgttatataaagtccagctgaagccataaactagactcttcaggtgtcatgatctctgtctttattaaatcaggagaggcattgctagatctgtgcagttggggctgagaaagagaaaagaattagggtgcagaggtgactccatgtccccctctaccaacaccatcagagtgtggctgcatctgaggaccactctcagctgatagaggcatcaggaggagcagctggggcagccctgcctcacacatctgcttccctgggggtttatgttcgggtgtgtaacactgtgggagaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggtggaaggagactgggtcatctggatgtcacatttggcacctgagattggaaatagaaacacaaatattcatactattgatcatattataggaagacttccctgaataaccaggcagtactgagcacactgggctgagtaaattcctagtgttctccttccttacctgggagccagagcagcaggagccccaggagctgagcggggaccctcatgtccatgctgtgtcctgactgggtctgactcctgcacaaagtgtgaccagcctattaataaggcttcagggcaggaggttgtgctctgggaacatgcaaatgagcaggggatggggcaggctgggcacagctgcagagctggctcatctcagtaactcagcaccagctcagtgtccccaggtgtcccaggtaagaccagggtagcacaaatttgtctgcagagaatgtgtttctactggggactattttattatgagaaacaatttttaggtatttttttgagaattttaaatattcctcaggagccgatagagtaatgtatttcattggtgtatcaggattatttaggagaatattcttgtttgtaggaaacacatagtaaaatgttagatggtaggattctcaagtcttcaaaagactctcataagattccgggtagggaagggggtaattgtgctatacctgcaacatttctgtgagtttaacattgttcctttctaaaaaaaattaaaaataaaatgtatcggcatgatgctatatatttgtaagtattaggtaatggtgttatgcctttgttcttactagtattagatcaagcaatttattacagatatacaaagatgataccgtgttgtctccatgcatgcagcactcacagatccaccactatcaagaactgcaggtctctttaatacccagagactaaatgaggtgcaccttattcttgttttgggtaccttcatagtctaccttcttttctgccattgggtattatttcccaaagttcatctgtcttagtgagggtggccactgcacggagcatgtccctgccatgcaccatcaatgacactttcttcttatactttttatcagtgcatggggacatcatcctgacccagacaccagcctccctgttaacacctttaggaaaaacatactcaatctcttatcaagcaattgtctatgtacatggagaaatcagttggatccagatgaaactggacatggatttgcattcattatatctcatatctctaatgtaccctgaacgtcccagcctgactcagtagcaggggaagtggatgtaaccacatcagcatcagtgggctgcagcctcgggctccacaaaattttactgatgcctgactaggggagcaaaatcacagtgctgcagcccatgcacaaacatttctgctgctttgtaagcagcctgaattttaagggaacttgcttatattggaagaaaggaagaaagttccatttgtcctctaaatgtttgctgaaaatgaaccgacaaaagaataatgaataagagaaaaggcaaacaaaattcacttagagtgcggtgggatatcatagtggggtgattacccagataactcaatgagatccagttgttcatatttcctttctagggaagagggaattgggaagtgtaggcaacctggagagaatagatgaaaaaagaaatgcatcctcaaaagaacaggcaatagcctgcctggataaagcatcaacttgcagtctcttctatttttgattcatgttttgtgttaatcttccctgatataaaatttcccaggaagaatttccttgacaattgtttttcttctggagaatttgcttttaggcagataagggatatttaggaaaagacttcttgtgcatttgctgctttctaaatgcctttggctttacataatcatcataccaatgcagcatagtttgagatgttattttctggattcctttacttgcagccacctgccaagatcctgtttcagagagatgcagctgcagattgagtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaacaggagagacagctcacaatcagtgaggataagatgaggtatatacatatcccagctttctcatctctcaggtggaatagcccagaggaatttagtccatgtttccacatgtggttgatcttcagttatcctgagtcaggtgggtggttgatgtgtcttttaccattcatcttctgctcctgcctcactttcttcctttcctcccagtgtaaatttgctgcctaaacaggaatactcattgctggtggacccaaaataagacagaaaaaaaaaatcattgtacttttgtatgagggatatttctcatctgaattcttatcacttctctttctttgacatctaggaatattcagaaaacacttttttttaaccaatctattttagattgaatttattgattttttttcctgtgtgttttgtgaaccaaaaattaagttgtaagccaccaacgagctaaatggactccccttttggcagagagaacttcaaagaaatctgaaaaactaggttaggccatgactggcaggtgggtttggatgtgtctcattatgctctcttccctttggagttcaggcacaactgaccagcattatcattataacagagatctttggactgaggaaacagatgcttgtagcaataagataccatactccaacatgacagataataggccctgaagaaaatctaaaaattttactctaaaaatatttctttttctttttcttttttttgtttttttttgagatggagtcgcgctctgtgcccaggctggagagcagtggcgcaatcttggctcactgcaagctccgcctcctgagttcatgccattctcctgcctcagccttccaagcagctggaactacaggtgcccaccaccatgcccgactaattttttttgtatttttagtagagatggggtttcaccctgttagccaggatggtctcgatctcctgacctcgtgatctacccacctcggcctcccaaagtgctgagattacaggagtgagccaccgcacccaacctatttctctgaaatattctgaagtggccctgcaaagctgcgcgttgtgggagaaatttgcattctgtagagaatctcctatgcttactaatcattttccaaaggtctgactttttttttttaaggtctgacaagcaacgtctactttttctgctacccataggattcatctacacgaaaagaaccttggcttatctaaactcaagcacaccccgttatctaaactcaagcatttctttatggtgaattcaactctttaggcagagcttaactctttcaaccagttgccaatcaggaaaactttgaagccacctgtgacctggaagcccctgcttcaagatatcccacctttccagtacaaactaatgtatatcttatatgtattgatttatgtctttgcctgtaatttctgtgtctccctaaaatgtataaaaccaacgtgtaatccaaccaccttgggcacatgtttacaggaccccctaaggctgtgtcacaggccataatccttatctttggcaaaataaatctataacttgattgagacctgtctcagatactgttttgcttacactgggtcacaaaatttaaaaatcctctaaaactatctacacatccataaatctacattagaggcagtggagtgagcacactccaacagtcaaaactcacaagttagaggaacctgagtctaagattttgtccagctctcttgcttcataaaaataatttgtgatttttttaaattttactctagagaaggacaattttggggaatatgtttatggtcagtggaatgaataatgtccccaccccaaaagatgtccatatcctcgtctctggaacccatgttatacgagttattaagaaactattttaggcatatagagaggaaacagggtccttgggaaggttttgtttcttttaaagcagctccagaaatgtttcttgtttagcaggaaagccctggctcttagagctggtccggcaagcttttttttcttttttagagagggagtctcgctctgtagcccaggctggagtgcagtggcacgatctcggctcactgcaagctccgccctctggtttcctcatgcctcagcctcccaagtagctgggactacaggcgcccgccaccacggccggctaattttttgtatttttcagtagagacggggtttcactgtgttagccaggatggtctcgatctcctcacctcctgatctgcccgcctcggcctcccaaagtgctgggattacaggcggcaagctttgatatacaaatactggccattagaaactgggtccagccaaacatggagattcccacattcttcttctttttttttttttttttttgagatggagtctcgctctgtcgcccaggctggagtgcagtggaacgatctcggctgactgcaacctctgcctcctgggttcaagcgattcttctgcctcagtctcctgagtagctgggattacaggcacatgccaccacgcccagctactttttgtgtttttagtagagacggggtttcaccatattggccaggatggtctccatctcttgacctcatgatccaccttccttggcctcccaaagtgctgagattacaggtgtgagccacggcgtccagctcccacggtcttcttccttgccccgacatttgcctgacaacatggctgcccccacatatccccatgtgtgtagaactttatggcaccctgcatttgcatattaaaacactagggtgggagggccagttttttctcaagctacatgaatgacatgcttggtaaaaccaatcccctaagccctatgcaaatcagacaccacctccttcagcctcctcatataagcagccacttttccaccgcacatggagttttctcttagttctaatctcccctctctctgtctctgtacggtggagctgttttcttcttccttccttcttgcgtattaaacttttcgctccttaaaacaaccccacgcatgtccgtttctttttaaacaaacccgcgtgagactaagaacggtggtggtcctccagtcatcagagccctatcataaggattctaccttacatagcaaaagaagaacttgacaggtgtaagttaacgactttgagaataagcaacctggttatccagatgaaaccaatataatcacaaaggtcattaaaatagaggaggaggcttgcagagaggagctgggacaatatggaaggatgtggtttgaggagggaaggggccatagagccagaaatgtgggagcacctggaagataaaagcagaggattcagttctttcctctggagcctccagaaggaatgcagccctactgacaccttaacattagctcagtgagaatgctgacctccagaactacagggtaatacatttatgttgtgtgaagccaataagactgtggcgatttaaacagcagcattggaaactaatgcaaggggaagaaatgtctttcagctcactgagcgcgtgcttgtcttctgttcttggaaatatttccaccttgttttctggtgtcagttatgacaagagacagagaaaatttttccgagagaagagctaccacgagaattcgtttttagctagaaaatctcctgggtaaaatctcatgattatctgttatacgatctgggtatcacagagtttggggtcagatctcacaacatgtgataggaggaagagggttttgttagtttgttttcatattgcgagggaaaattagattttcaggacacaatctgagaaggacagacagagtcagagatattgtaagagaaagaggagatgtggaaggagtcagggcaatgaaacacgtgtcccagctcccaaatctaaaataaagtcattgattttacaaggtgaagaaaagctcttcaccttccatcttcttaggaaggatcaaattcttcccagagtccctgcccctccttcacccccctgacattgcattgtggagctaatcacatgtgcccttaatccctgctcctgtcccaggctgggagaggctcactgtcctcaccatgcccagcaggctagagctggtgccctaagcaccaaaggagaagaggatgatttctgtgcaggcaataagagctttaccgcattttacatttccctaaaattctaagcaaagttctgtggagagaagagaacatggggcaactttatctggtggggctggaagagaccaggctctgagaatgacaattaattcacatttctacttttccagatgccaaatgctagctttatcaattgtggaaatgtggactttgagtttaagaacaggtttcaggtactgcaataattgaggagacatttggaatagagtccttagtctagggctaaagtcagactggcagtgcctgagagcttccaggcgctggccctgggctgtgagggaagcagcagttctcctgagccacagggctgaggacctgggagcaaccacaggccttggccacagggctgcctggcaggggcttgagggaaggaaactgctcacaaattcacaggagctgcattaagcatatatcccgcagcctggcaagagtgaaagtctcagagacccagaccttagggctggggctgggattctgggctggctgctgtcggctctgccctcccttgtcctgaatgactggcaccctgctggagccaaaaatggagggtcggccaatgtcctcaaagtctttactcagccagaccctgttctgcttggaaagaaaatgaacacatggtatacaaataaacataaaatcatgtgtatctgtaataagaatttctaatataaattttacatattgaatacatatattttagaaataagttgtacttatacatttgcctatactatgtgtctatttatggataaatatgtggtacatgtttatatataaagatatataactttggttgctagtataaggtatagttttaaactttaataaagtaaacacgaacattgaaaatgagcactgggtgcaccacttcatggccctcctcactccagggcctaagggtgataaagctcaggaccctcttccatgtcccccggcatggacagcagtgaactacccattgctgaggatcatgagtgacctgagggggatctgcagaatcacagagcagcagatgcccagaagattgatagtttggaccctgaatggagggacattttgatcacagggctcagcatagacaagtactcttctggtcatttctgtcaaacaaaacagcacatgtagctcagaggctgcatgatcacaggatgaagcacctccatgagtcattgccagcttcccctctgactggggtgatgtgggatctctctgccccactttcatggctcaccagctgctgggactctgttgacagtggtctacatctgtcccacgcacaaacttctcaatagttgtcattttacttactggtctccaataaccacaaattgccagccatgacccttccacaaaaattgatggagtggggttggaactatgggttcagcaatgtgccagggcatgtatataagagaaacaaggtgtggccagcccatgtctgaagtgaggatgaattttcaccatgaattcggagtaggaggtggaagaaaacatcctgacatgctccaggcagtgatgcccacaagatacactagaagcgcccacagaggaggtgggaagggggtgtgagaaaaagagggagtgtgaatttacaggtgtctccagactgttcacctgaaaagagatcagacccttaacaacacctgggaccccaggcagagctgttgctatggaagatttgtgcaggacagggataggaggagggagcacctacctgtgatggcatcttggttgctgttggccagaatgacatcttttcaggcctactgtccctgacccaggcagggatcatgtccaggagggcagcaggagctcagagccaggccctggttctgctagtgccaggctaggatgttcttcatactctggccagctctacaggtgacagtgaccctctcccctgagacacaaggaggaggacaacgatggcatccacataacatgctcactgtcatccaagtgggggaacaaacatgcagatccccaaatattaataccgagtttgtagttcctccaacttggtgcaattctgatcagaaggaaaaacaggctaacaacttcatcagcagggaaagttcatgtttaatacaaactatctgaggctgaagcctgagtttcccttcctcaccaggcagtcaggacagcaggagcaaaaggagaaaagctgggtcccaaagtccacaaggtgcctcctgagactgatcctgcttagagaaggtggtgacagtggatgagtcttctgggactcccacaccaacataccctgagctggatggcttgagccatagacatttattgctaatttattaaacgtttattgtgaatgtattagaaccctggaaagttcaagatcaaagtccagaaggatttgctttctggtgagaaccctgcttcttgttttcagatgtcacccctggatacatcctcacgtgtgttcagcaatgtgccgggcatgtgtaagtaggagaagcaagtacatgctttcttcagtgcatgcttggaggctggtgaggggttaaggaacagatcgatgatgtttatttttactaggacacaaatcctattaaatcagagccccaaggttttcacttcatttcaccctaattaccccttcataacctctatgtctaaatacagtaattttgcaggttggagattcaaaatatgaatttgtgaaacacaattcagttcatagcaggtgtgctttgaggacatgcccaaggcagtaggaagggcaaggcgaggcttccagtctcagagcacagaaggcgttttcccaccactcagcacactggcagctcctcttaggtgatccaggtcacacatgagacgccattcccgccttgggggctgcctgctgataatggaacaatatcacccttaattttcactatttctaagatcagacttctattttatgtttattatggagtttgtccaatggccaggtttgtaacataacctccaatgtttggtttgtgacataacatcttatagaattttagatgctggtttccagtgagacttgatggagttttttcatgggttttcatggagttgatcttattacatccaccattatgctgcattctgtagggaacacaaaatgattcctctcctcaataaaccagtcacctagttgaagataaagggtgttcagaaaagatggtcacaaaacaattaggggctagattctgtgatccatgtgagatgccaatgatgtgattctggaaagcagaaggtgaggttgtgagataccctgcagcacataatgcccaaggctagggtggcgagtagagggcccctggtctggatctgtctacccagcttcattcctcccattcgtgaaacagtggctgcaccagccaggaagcatctgagaccacctgattctctggaataatagctgctgaggtttgtgctgtgagctataacactgtgagtctctaactgtaaccatttagattagcactaatgaaaataatttttaagatggtgaaaatgtctatatctatgctttgcaagtgtagccgttatatgtcatatgtgactcctgaacacttgaaatgtagtgaaaacaactaaggaactatattgttaattttaattaattccaatatacatgtttgtggctgggtactgctaatgttggccatgtgagtcagggaagttttagatggtaataaacagcaatgtcatcaggacaaccaatctgctaaatgttaagcaaagatgatcccaggaccattgcaccaagctggagtggacaaggtggaaagagcacgtaggtggatctttggaacccagattctgcttcctccaggtgaatgatgtaaactctctgtcttgaagacactgacattgaagctagcgactggggagctgagtgtttctcctggaagctgcagtggaaacagaacatagatcttccttagtattactcatgtccctctccataggcttcccagcagagaggtgctgtctgatcaagtgggaggtgaatgctgtgctccctaatcaatagtctttctcagtcccatgggacatatgaaccctgtcacatgcagcccacgcagttgaagccagagccccatgtccagtgtccagtgttgcctctgccttcggtgatcccaccctacaggacccagtgatgaaggcttgagtggcagggaagagctttggggagcctgccaactagcaataagggtgcagacttgggcttccagcttctgagcaagggaacattgtatgtcctaggtgtgatccaggtcaaggtgtttgataaaagatattacaataaattattttcttaagaaaataaaaacacagaaggcatctgattattataggactgtttgggttttataccactaaagtggtaaaaataaatttttcaatgcgcagtggtttatcaggaatctcccagcccctgcccttcccgtgatgattctgtagtctttgcaggttgtatggtcacttggtggcctccttaccgatcagatgcatctacagcacaaccctaagatcttccccgattaacatagatgagcaacttcaacctccagataccacataccattggctgatttttatgcaatttatcaacactgaaagtattctattccatttcattatgtagttattattctgtgcatggctcattcccctactgagtatcagtatttgcgatcaaaaattgttttatttacttacatgcactaaaccttaaatgatagcatttattagttctgaaaactctgacattaagttaaaatcccttaaaagcaactatatgcttctttttttaattagaataaatatggtgcaatcacctcaactaaggatactaaactacttttacagttgaaaatgattaattggacatggggaaacatattgacaaaagtaacaagcattattatgatgttgaataaacacagtttgcatgtaaagtgtacagttatgattaattgtattaaaacacaggaggaagaaaggtggggattgctggattggttggtgattcagtccttagaagcaagggggagctgatgagtgatctcaggcaggcatccaatataaggtccaaatatgattaattacaatgttcttttccttaaggtttgatattttaagctggtcctgctggggaagttttgagcacattcatggaatatgtggaataaagattaaaaacagtatatttcaaaatactcttaaaaagctcagaaacacccaaagaaaactattttataaaatatcatgccttcctcgcccattcttgatatttgtgtttaaccaagcatgactcacaattcaacttttctccacattgttgcctagagtgttgaagaaattcctctaataggacagaaatggagtcaatcttgcaatatctggccaatcgtgttctggccagtcttgctttatctcagaatgttacatttccagaaacttctacagttattcctgaaaactacaagcaagaaagggaaggagactgggatcattcaaggcaaaatggaacctgttctgcaaatactgtagtgaaatcataactcagtaatcgttttgtgactggcttatttcacttagtgtaatgtcctctagtttcatccaagttgtagcatgtgtcagaatttccctttttaaagctaattttgcctttttaaagctacaatatgctactgtatgtatataccacatttggattaccagttccctcctttgtgaacatttgagttgcttctaccttttggctattgtgaataattcggttctgaatgtggatatacaaatatatcctcaagttaatgtcttcagttacttgggtatatgtccaaaagtggaattgctgaattatatagtatttctatttttaattcttcgaggaattgccatctggtttcccacagcaggtgggccatttacatcaccacgacagtgtccacaggagttccagttccctaagttctcaccaagactggtcattttctgttggaaaaaaaatcctaataggtgtgaggtgggttttgtttttatttttctaaggattaataatgttgaccatgttttcctatgctagttttctaattatctctatagaatcttctttagagaaatgtcgattcatgtactttcctcatttttaatcaggtattttattttaaggttcacatataagacttatttttgtatagtagatattattaaccccttatcaaatataagatttacaaatgttttcttctattccacatgttgcattttcactgtgttgattatgtcttttgatgcccattttacatttttatgaagtccaatttatcttcttttctacttttgcctgtattttggtattaaagttgttagtatttaaatgtctataaatactgacttactatgctgagaaggtcacactgcaccatctctctgatggtggagctaagagttttacactctcccattttgtaccgggggacagtgcagctatgtgagaacccagtggctttacccagcttatttgtcttgcatttttggtgacatggattgttattcacattggcttcctctggcaggtccacctggaaagcattatatttagcaagaaaaaaggaggcagtgaatgatgtcactgtggactgtgtatattccctgttgcaaatgtcaaattcgtgaagcataaagggatttactagaggatattaaattccttgcaaattgttgaaaagccttaaggaacaggctccaggcaaagcctctagaacaattccaagaatggcactgctggcacaggctggggaggagctcctcctgcctgagactccacaacattcaagctgtctcctgcagaaaagagagcagctcttctcactactgcccccagaaggacagccgctctgctatcaactacgagagatctgacccctttctctgactgcccatcagatgtgttactacagagtgcttttggattgagatgagggagggaaaatgcctgatctcactcaaatgtgctcattttcctggtctgggtctcagccaggcagcacagtcctgtgggcacagtatcttcacttgccaggttcctataaaatgagagtatctttcttgactgtggaaaatatggggatggtaagggtcaaggaataggaaaaggagtacttggagttgcctgagctgccactctggtttccccaaatgttttcaatccattaaattcatgataataaacacctttctgcctaaccagccataatcgcttttcttagatccaaatgattctgtgataaaactaaagagaaaaaataaatacacttttcaacgtttaagctgaccaggaggctgtctctggtgtttacatgtccatatcccactatgcatttcgtcttccctttgcctcactggagatccaagtgcagggaatgcttcatatgactgtgatccctagaacttcatcctcatgactgttgaaatcttctctgagttttaccagtggaaatggcaataaatagaaagattccagaaggtcccctagggtccatattttctgtacttcctctctaaaatatgtaaaatcaattatatttgctcttgctttatatgggctacatctgtgtccccagcacacaccctaacgccctgcgttgacaacttatccagtattgtattaagtctaaataggcacatgtttatcatattatttcttccaatttaatgagataattgtcatgtcaaatctttggattaagaaccatcagccagaaaaccacagccctgagaaaatagaaatagagtatttcaagctgttcagtttgcacaacaatgatgattctatagctcatttacaagatataaatattctgtttatgggagtaagagcaacattcacggtgagtgttgtagaccctccgccacatctgacagcatagcaattcaatagcacaagggtttgtgtgccagcagtgcttgactaataatgggttttttttctatagggaaagctgcacctgtgcacatgacaggatcatgagctacactttacttcactttttttgaagtcaattaccttcttgatccaaagccacagtatggaagaacttcctgactctgatgaaggcatttggaaaatcctcaaataatattttatgcagtaacataaccaaagacaaaggaaaattcatatataggataataaccactgctctcctcatgttacatgaagtgcacttgaatcacctgacatcagctgttagtatgagccctgatgtgtggtagaatgttaggggctcaggaagggtcaattttcttggcaaattagtgttcaagagagccagtagccctgtacatctcagttagttgaaactcatattattgagtccccacagggacctccgtaacagtggttcatgaggttacctgggaaagtgggcaaaggtgactgactgaagtccatgtgttcaatcatcctcattatgaaaagccccctgctcattaatggcatttggattaatattcactgagaaagcatgtttttcgattatggctcatttttgaaacatctagtcatagctcttccaaaatgactttgtctgcaatcatcctgttgtgtttcttttaaggcctgatgatctgtcaaaaccaacaaccaatattattaaattgctgttctctttgcaatgtggcaatgtgatcatcagatgtaggccttgcagtttacccacggttaggatttttacatttccagggattccttgacaatggcactaatgtgacgccatctagcatccattgttgtgagaactctatttggaatatcatcattgtgggcatgaacataatggagactttcataggatgcaatgattaatattcaacattagtcaaaatctgctgtagtcctacccttggagatctactggtttggaaaaatattttaggtaaggacaacaatttggtaaagttttaaaaataaaggctaaaaagaaattttctttagcaagagtatgaactatctgtggtccagaataccatttttttacagatgcaagaaaaaattatttaaatgtatataatttagataataattttgtaaatttgtatatattgcatatataatagaataaacataattaaatatgaatactatatatacttatagccaacattttatcaaataaatatatattaacttctatgtatcttatatatatgcacatttttccataaataaggtaaattttaattttttaatgaaatactaattagttttaatttcatctttaattttctcttaataacttcataatttgattacttaatgttcacatttataccaccaatttaagaaaaaacacatgtatctatatataggcagaggtgtaaatactgtatcagtaagcttttatgcattaatgattgataatcggttaaatatacaactcagtggctgataactgtaaatatttgttttcatcttcatggatgctcatgttcacaatcatctggctgattaaggaagggctcagctgattgattcctccgcagggcactgagcttgtctttagcctacagataccaattttctgaggacgaggctgaacagcagtgactacacgtgacacaagattcttgtgacaggtcacaggagtgaacaacatcccaaaccgaactgcacagttgaatttaagtccaataatttctaacatagcttcacacattttaaatatattttttgatttcagtgagtacaaattttcaagaaaatgtttactccaattaattatagaggtgtttgatcattccatggacaagtaattatgttttcaacctttacaatcctgaaaatatttgcaaacgtaaatttgcattaataagaaaataaagctggatgtgttttcaacatgtgcttttaaatataatttttgaaatgacctcaaagggggaaaatcattttaacttatgtaactatccctttttacctctcttgtgtcctatagagttgcccaataagaggtcctcccatgagatttggaatcagaaaaggatgactcaatattctccattggtacctaaggcagacacaggaacagaggtgaggactagagaaacacctgaaaagatgctgtaggaagctgagagcatcagcacccccacccctaagcttccagacaggactgaggaccacatggttagaaagcccttacttcagggacagatgcattctgttttctgagggagcaccagagattcctgcttctaatatcagctttcctgactactatatccttggctttgaaaggtcatagtgggaaagttaatcataggaattcggtcattcttgtgatacccgacagagccaagaaaccaggagggaaaggcactcagggtgaaaaatactgtttctagaatgcaattgaaataggccctattatcccatggaactaaagtttatggttttttgaataaacagaaatcgactcctccagtcttaaaactcaagatagcaacatttatcttacctttcttttttttttttttttttttttaaatttcaggaaagcaaccatcaggcctcccagatactatcaatttgctgaaacttatatatcactgaatcgggacagtgagacatcagacccttcacccattatgattgcctaactgacctcctgcttcctgttgacccaattatctttcttaaccctccctaactcctgtttttccacatttcttccttgttatataaacccctaatttcagttggtcagagagatacatttgagaatggcatcccatctcctcagctgcagcacctgattaaagcctgttccttgaaaatacttgtcttagtgattggctttctgtgtgacgagctgcaggatctacaccgaatccctggcatttcagtaacaaaattctctgcaagcttcaccgttttggtttattgtaacctgaaatcaaatttatccaaaacttctgagataacttgatataattctaggattcactttgtccaccactgcttaccagtctgagcttgccagctcccaacccttcctagtgccaatgagctttctcaaaagagccataggtaacattttccctttttcataaaatgctaaatttctctttgttcttccaacatattgaagaccactgagttttcctgtatgccccatttggcaaatatttctttgcaaataaaacattaaatttagagattcatctctacattttatttagacttcagtagtttactctaattctctgtattaagactatatctgcttcaaatatctatagtggcttcttctctgttatacgaattccaactgaagccataaactagactcttcaggtgtcatgatctctgtctttattaaatcaagagaggcattgctagaactgtgcagttggggctgagaaagagaaaagaattagggtgcagaggtgacttcgtgtccccctctaccaacaccatcagagtgtggctgcatctgaggaacaatctcagccaatggaggcatcaggaggagcagctggggcagcccagtctcacacatctgcttccctgggggtttctgttcgggtgtgtaacactgtgggagggtaattgtaatcttgtagacagtaataagttgcaaaatcttcaggctgcaggctgctgatggtgagagtgaaatctgtgccagatccactgccgctgaaccttgatgggaccccactttgtaaactggatgcagcatagatcaggagcttaggggctttccctggtttctgctgataccagcctaaatcatttctaatgccctgacttgcccggcaagtgatggtgactctgtctcctacagatgcagacagggaggatggagactgggtcatctggatggcacatctggcacctgagattggaaacacaaaaacaaatggtccacacaattaatcatgtagtaagagaatttccctgaatagccaggctgtgctgagcaccctgggctgagtaaactgccagtgttctccatccttacctgggagccagagcagcaggagccccaggagctgagcggggaccctcatgtccatgctgtgtcctgagtgggtctgactcctgcacagggtgtgatcagcctgttaataagtcttcaggtcaggagactgtgctctgggaacatgcaaatgagcaggggaaggggcaggctgggcacagctgcagggctggctcatctcagtaactcagcaccggctcagtgtccccaggtgtcccaggtaagaccagggtagcacaaatttgtctgcagagaatgtgtttctactggggactattttgttatgagaaacattttaaagatattttttgacaatattcctcgagagtcaatggggtaatatatttcattggtgtatggggattattttggagaatattcttgtttgtaggaaacacagtacatattagatggtacgattctcaggtcttcaaaagactgttataagattccatttagggaagggggtaattgtgctatacttgaaacatttctgtgagtttaacattgttcctttctaaaaaattaaaaataaaatttattgacatgatgctatatatatttgtaagtattaggtaatggtgttatgccattgttcttaccagtataagatcaaacaatttactacagatacacaaagatgatgccgtgcttcttcaatgcatgtggcactaacagccccaccattatcaagagctacaggtctttttaatacccagagactaaatgggctgcacctgtgtagaatttttgcatccctaacttaagtactaatagattgcttttgattggaagccttagcaataaaataaatagttgattaacatgttttttaatgttatatatattatatactctattattccaataaagtatgctaaagaaaaaaatgttattaaggaaaccataaaatagagaaaatatatttactacttattaagcatttgcttacaggtgacacacacagaacaaaatataagtgtatctgcaaatttcaaacccaagttattcaagggttaactgtaccatgatgaacgtagcagtccccatctgtaatctagggctttcccctttgctgtacctctactcatttccaatgaccatatatatgtcttatgttctttatgatcttgggcagagaactctgcctggatgcattgctggccagatggcctggaatgtgtatctcttaggaaagtgctatggtttgactgtgtcctccagaatccatctattgtaaagttaattctcagtgtaatggtttttgccaggtggggcctattgggatgtgtttaggtcatgaggctggagccctctagcggaatacattaatgccactataaacaggaattacagggctgagatctctctcctgctcctctgacatgttaagacatggccttccttcctttgaagaactcaacgctccaggcatcatcttgaaagcggagaaagcagaccatgtggttgatcttcagttatcctgagtcaggtaggttgttgatgtgtcttttaccattcattttctgttccctccctcactttcctcctttcctcccagtataaatttgctacctaacaggaatccttattgctggtggatccaaactgagagagtaaaaaagaaaagtcattaatcttttgtatgaggggtatttctcatctgaaatcttaccatttctctttctttgatatgtacaaatattcaggaagcacctaatttttttttttttaccaatgtatcttagattgaatttacgctgtgattttttttctgtgtgttaaaacaaaaaatcaagttgtaagccaccaacctactcaatgggcttctcttttggcagagagaacgtcaaagaaatctgaaaaactaggttaggccatgactggcaggtgggtttagatgtaactcattatactctcctccctttggagttcagacaaaactgaccagtgttatcattacaacagagatctttagactgacaaatcaaatgctttgtagcaataagataccatactccaacatgacagataataggccctgaagaaaatctaaatattgtaccctaaaaatattttttttgatgtattctgaagtggccctgcaaagctgcctgttatgggggaaatttgcattctgcagagcatctcctcctcttactatgtcttttccaaagagttggacatttctttaaaggtctgataagcaacattcaccatctactttactgttacctgcaaggttcatctaagtgacaagaaccttgacttccacacccccttatctaaactcaaggatttctttatgatgaattcaactctttaggcagagcttaactctttcaaccagttgccaatcaggaaaactttgaagccacctgtgacctggaagcccctgcttcaagatatcccacctttccaggacaaactaatgtatatcttatatgtactgacttaggtctttccctgtaatttttgtgtctccctaaaatgtataaaaccaacgtgtaatccagccaccttgggcacatatttgcagggcctcctaaagctgtgtcacaggccataagccttatctttggcaaaataaacctatacattgattgagacctgtctcagatactgttttgtttacactgggtcacaaaagttaaaaatcctctaaaactctctacacatctataaatctacattagagacagtggagtgagtatacctcaactcaagtcatactttgagtttaagaaccagacagattttcaggtacttcgataaatgaggagacatttggaatagggtccttagcccagagctaaggtcaggctggcagtgcctgagcgcttccaggccctggccctggtctgtggaggaagccactgttctcctgagccacagggctgagaacctgggatgagccacaggccttggccgcagggctgcctggcagggtcttcagggagggaaactgctcacaaattcgcgggagctgcattaagcatatatccccccagcctggcaagagtgaaagtctcaggacacagaccttagggctggggctgggatcctgggctggctgctgtcagctgtgtcctcccttgtcctgaatgactgggaccctgctggagccaaagagggagggtcagcaaatgtcctcaaggtcttcactcagccagactctgttctgcttggaaagaaaaggaacacatgctacaaaaataaacataaaattatgtgtatttgtaatatgaatttctagtataaactttacatattaaatacatacattttagaaataagttatatttatatatttgtatatactatgtatctgtggataaatatgtgatgcatgtttatgtataaagagatgcaagtttcattgctagtataaggtatagttttaaactttaataaattgaacgtgaacattgaaaacaagcactgggtgcaccacctcatggcccctcctcactccagggcctgagggtcataaagctcgggactctcttccatgtgccccctgggccgatagcagtgagctacccattgctgaggatcatgagtgacctgagggggatctgcagaatcacagggcagcagatgcccaggagatggatagtgaatttggaccctgaatggagggacgttttgtccacagggctcagcacagacaagtccttttctggtcatttctgtcaagcaaagcagcacacatggctcagaggctgcatggtcagaggaataagcccctccatggctcattcccagcttcccctctgactggggtgatgtgggatctctctgcccagctttcatgactgaccagctgctgggaccctgttaacaatggcctatgtcagtgccatgcacaagcttcttgatagttaccattttactttctggtctccaataaccacaaattgccaaccatgaccgtttcacaaagattcatggagaggggtcagaattatgggttgagcaacgtgccggggcatgtatgtaagagaaacaaggtgtggccagcccatgtggaagtgaggatgaattttcatcatgaattcagagaaggaggtgggagaaagcatctgacatgcttcaggcagtgatggccacaagatacattagagatgttcatagaagaggtggcaagtgggtttgagatgaaaagggaatgtgaattcagaggtgtcccccagcctgttcccctgagaagatttcagacccttagcaacccctgggcccccaggtagagctgttgctagggaagatttgtacatgataggggacaggaagagggatcacctacctctgaaggcatcttggttggtagtggccagagtgacatctgttcaggcccattattatccctgacccaggcagggatcatgtccaggagggcagtaggagccagcaggagctcagagccatgccccagttctgctggtgccaggctaggatgttcttcatactctggccagccctgcaggtgacagtgaccctctaacctgagagacaaggaagaggatgaagatggcatccacataacatgctcactgtcatccaagtgggggaacaagcatgcagattcccaaatattaataccaagcttttatttcatccaacttgatgaaattctgatcagaaggagaaacagtctaacaaattcatcatcaaggaaagttcatgtttaatacaaactatctgaggctgaaacctgacttccccttcctcaccaggcagtcaggacagcaggagcaaaaggagaaaagctgggtcccaaagtccacaaggtgactcctggggctgatcctgctcagagaacgtggcaacagtggataagtctgccgagaatgccacaccatcatactctgagctggagggcttcaaccacagacatttattgctaatttattagacatttattgcgaatatattagaaccatggaaggttcaagatcaaagtccagaaggatttgctttctggtgagaaccctgtttgtttccagatgtcctctctggatacatcctcatgtgtgttcagcaatgtgccaggcatgtgtaagagaagcaagtgcatgctttactcagtacacgcttggaggctggtgaggggttcagtaacagctcaatgatatttctttttattaggacacaaatcctattaaatcagaaccccgatgttttcacctcatttcaccctaattacctcttcataacctctatgtctaaatgcagtaatattggaggttggagattcaaaatatgaatttgtgaaacaccattcagttcatagcaggtgcactttgaggatatggccaaggcagtaggaagggcaaggcaaggcttccagtctcagagcacagagggcattttcccaccactcagcacactggcagctcctcccaggtgatccaggtcacacatgagaccccattcctgccttgggggctgcctgctgataatgaaacaacatcacccttaatttcactatttctaagatcaggcttctattttgtgtttattatggggtttgtccaatggccaggtttgtgacataccacccaatggcaggtttgtgacataacatcttatagaattttagatgctggtttccagtgagacttgatggagttttttcatgggttttcatggagttgatcttattacatccatcaataggctgcattctgtagggaatacaaaacgattcctctcctcaataaaccagtcacctagttgaagataaagagttgagaaaagatggtcacaaaacaatcaggtgttaaattctgtgatccatgtgagatgccaacaatgtggttctgggaaagagagagtgaggttgtgaggggccctgcagagcacaatgtccagggctagggtcgggagtagagggcccctggtctggatctgtctactcagcttcattcctcccattgttgaaacagtggctgcaccagccagcaagcatctgagaccacctgattctctggactaacagctgctgaggtttgtgctctgagctataacactgtgagggtctaactgtaaccatttagatcagcactaatgaaaataattttttaatatggtgaaaatgtctgcaaatttctaacagaaaaattgatgaaaagatggtttttcttaggcccccacagcagtctctgcctgggacctgactttgtctttgagccagtggaatctatgctgagattgtaagctgggcagggaaatcacagcagggcaggctgtgctctgggtgctgaggaggacaggaggacactccttcagggttagtgatgctgggagttcgaggggagagactgcatggagctgcctgtgaatcgccctagcaatgccctctggacactgctcatctcacaagtgtactcggatgccagtggatggcccaaacatgggctcaggttggacaaggacaaagatttagggatgaatatatggggctcatttgatactctgaagtttcagcacaagcataacgaattatatggggagagaaagaagtcacaaggttgtgatttttcatttggtattaaaatatatcccctctgctcatttttccctgcagaatgtaactactgatacatatttaagcaaagtcactgtttttaattgttttagtaactgacagcctgtgtgcacagttcctaagtaactgggtagccagaccatcattcctatggtaaagccaggaagtgactgtggatgtgaacaaatgtgagtttaatgtacatgtctccaaagccacgggccactgatctagggagaacctgcagtcagtttgctttcccatgcccagatgagaggacaccttgatctgtgttcttctgatgaactctaaaaactctaaaaactgatgaactctaaaaactaatattctgaaggtctagttcatacttcttttctttgctagagggactctctcactcacatgtattgtactctctgcatagaacagtatgtgatacatacaacttgttttctgctaaatacccatcaatcatgtcattcatgagtcttccatagatgttacctgccctatgaatctgggctcttccaaaagaatgggccagaggtggagctgtgctttcacattctcttgtgcttccctcgtggacaacctttgctagttgtcacccttcccacccagcaaaagtaactgtctttctgacatctacacaatcatttaggttttcctgtcttaaacttcatataaatagcattatgtgtatttttatctttttagtcttggtattattccttactacttttgaggccttcatttcttccagtggactcaaggtcctgtctgatgtcatttcctgtgattctgaaggattttctctcaaatgttttataagacatagctgctatgaatgaatgtattttgtttaccaaaatttttttttttgcctttttgttagatttgaaggatattttcactggatagatttcctggctgccttcttttttttccttttcagcatttaaatatgtcattttactgcttctagcctctattggtcccgatgaaaacttagccaatggctacgttgttgtgtctctgtatatagtgtctgcttttattctgatgcaatgaagattttttctttgtctttcaacattttaatatagtgtgttcacttattaatttctattgactatctaaaagggttttattgaattatttcatctaagaatattttttattacttttgaaaagtttttgtcattgtatctccaaatattttttcagccactttctctgtctctccttctttgtgactctcattatacatttgttggtatccttcactctgagctataaatctctgacatttcttcctttttttctaaacattttctttaggctcaaacatttccattcctctattttcaagttaactgattgttctgtcatctcaatttgctattagacctagctaataaatatttaaattgtattatggtacttttcatttctagagttcccatttggtcattttttatactttccatttcttttcttgaggtcctacttgctgaatcttctttttaaaaatattttcgtttttatgtcaatgatcatagttttaaaaataattatttgaacatctgcatattaactgctttgtagtctttgctaaagccaataatgaggacaagttagaatcagctttcattggctattttctgttgtcattattgtagttgctttactttgttccttcaatataaatcatactcctctgtttttttttcaggattttttaaaactgaaagctgcacacttttgataatatattatagtacctctctttagattgtggggtttttattttaattttaatttttttagaaacagggtctcactctgtcacccaggctggagtgtggtggtgtgatcatagctcgctgcagcgtcaacctcttgggctccagtgatcctccagcttcatcctcctgagtagctgggactataggtgcatgccaccactctctgctatttaaaaaaaaaaatttgtagagataagggtgtcactattttggccagcctggtcttgaactcctggcttcatgtaatccttctgcatcaggctctaaagtagtgggattacaggcttgagctaccatgtcaggcctggaactggtttcatttttctgagcattttaaaatttttttcttagttacttgtcagaacttacttctggtacctgacttatgatagttggagttatcattttttgactttcagatggtgtgaaagtgatatgcattcaagtagaaatagtacttctagtatttatacaactattctatcttctctttcaatagagtattcaataaattgcatgagatattcaacactttgttgtaagataaggtttgtgttagataatgttgccctactgtaaactaatgtaagtgtactgagcacatttaggatagaataggctgagctagtggattacatatattaaatgtattttcaatgcatgatattgaaaaatctatatctcatatggtgtttgaccactgatatctctgctttttattcttaatatttagtttgaatttatagaaactgcacatgtatctgcacagcttagtggtcaccaatgatttgagaagaagttttgctcaaatatctggaggttataaatctatcttctgtcaatccatctgtgtgtagtttaaaaagctcctgcaaaatgcagctagttcttacctccctctggttttactttgcaccgggcacttctgggtctcatcactcatatctatagcttctaagtcaccaggaatgtgtgtagagattgtttcagcaatatggctctatcttacccaggaatctgctatttactgttagcaggtgtactacttgccccaaacagggcatcatctttgactaacaaagctgtgggctttttctgttcattccctatggagttctgcatgtttagctggaaacactgaagaattttacttcattccttggctttactcaagttcacccgctttggcagcaagctgctagctttatttgctatcctcatattggtaaaactccagttctgtatttcatgctgactgagctgggggtagaagggtgctgtcacaggcaaaaggctacagactttttctgtccttactcaaagcactagtacttttttttctataaagaatatacatctttaattattttatgcttcaccaattttcagagtgctgaaatagttttgatattttagctttatatgtgtgtttgttatttatttttgcacagaagatttattaaactctttgtgatgccataaacagagatgccttctaaaatgcatttaaatgaacataatagccatgctgaaatggaatgaggttatttactaacataagtaattttggacttgagaacttgaactcttcaccctcagtttaaagagaaaccaaggacttaaaaaatagagaatcctggtccctggatttcacattcatgaagaaatgcacagtcaatttttaagatgccttctttgtattctagaactgagcaaattagtgattacactctacataatgggagctatgattgtctttaatagagataagaattagaaataggaaaaggtagctgggtgcggtggctcatgcctataatcccagcactttgggaggctgagacgggtggatcacgaggtcaggagatcgagaccatcctggctaacatggtgaaaccccgtctctactaaaaaaatacaaaaaaattagtcaggcgtggtggcgggtgcctgtagtcccagccacttgggaggctgaggcaggagaatggcgtgaacctgggaggcagaggttgcagtgagccgagatcatcataccactgcactccagcctgggtgatagagcaagattccatctgaaaaaaaaaaaaaaaagaaagaaagaaataggaaagtgcaaaataggaggaaacttgtggaattgtttaaaaactacctttttcttattttttagttacttgtgtgtgtgttttaagtttatgtggaaatacttttagacctaaaatttgaaaaatatggtaaaaatgattcccatatgcgcctctttcagcttgctctaatgtcagcatcataaataaccacagtataagtatcacaaccatgaaatgaacatagatataatgttatttgttaactcatttaaaataccatatggatttcactgatttttcctgttgatgactttttttatgttacaagataaaattcaggtttctgtattttatttggttatcctgtcctcaatatctttaaatctgtgatagtttttcacttttgtttctctttcatggccttcaaacatttgaagtttactgtccaggtatgttgaagaatgtcctcctagttgggtttgtatatggtgtttactactgattcaattcacaccattaatttttggcaagaataatacagacaggatgtatcctcagtgcttcacatcagatgttacataatgtcaacatgtcttataggtggtaataaacgaatatgatcaatgaaatcccatttggaaggaagttttggacaaaaataatgaaaacaactgcttctatcactctttctactaggtcattgcagacgtcattaggaataatctatttcttccttatcgaatatgtactttattttaacaaactttaatctttttacagtctactgcatcacagagaaaattgaagaaataatttagttaacttttaaatggcaaatgtttccataataaccatttgccactgaaatgttgatagcctgaagaaagaaaaagaatgggatttattcagccatggtagtatcttcacatgaacagcttttaccgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaacagagtccaagaatcaaagtccaaattgttcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgctagtggccctggtggatgcaccatagatgaggagcctgggcgcctggccaggtttctgctgataccaggttaagtagctgctgctaacactctgactggccctgcaggagagggtgactctttcccctggagacaaagacagggtgggtggagactgtgtcattacaatttctctggtggtatccaagattggaaataaaacagaaatgcactcatgtaatctagatcaaaccagctgtctttgagtagagccaaaattgttgatctacattgaattttaattatatttcttgctgagcagaggtggcaggagttttcactgatgtgcaaaaccacctcatgttcccctcacctgggagccagagtagcaggaggaagagaagctgagctggggcttccatggttccgtctgggtcctaactgagcagttccttcccagggctctgacccaggcattgatatgggctctggaaggtagggcagctgggagggacatgcaaagcagctgggtgggagctgagcttccagctgcagagaccacctgcttcttcctctctgcactgagcgtcctgtgcctccctggttgtcaggccagaaaagtctgttggctcagtctgagtgtagaactcctcccttgtgctcacataatttcactcctgtgcctttcttctcttcaatcacctaaatacacccgtatgatatttggcacaagtctgttaagaacaatataaaaggctgtgttttcatttctctcttcctgtcctcagtatgcccagtcatctccctaagtgcattattggatctatggaaatgaagagtctgttagaacttaatcttccagatagacattttttttttttttttctgagacggagtctcgctctgtcttccaggctagagggcagtggtgcgatctccactcactgcaagctctgcctcccgggttcatgccattctcctgcctcagcctcccaagtgcctgggattacaagcgcctgccaccacgcccagctaattttttgtatttttagtagagacggggtttcaccatgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagacacataccctctttgagttaaaaacttctgtttacagtcacatgtcctggcagccctgacatagatgctccatggcttgccgattgcttgaaattaatcaagtaacttaacttccctgtgtctcggtttccatatctgtgtaactgtgacaatagtggtacctgccttacagtgctgtagacagtttaaagaaaataagataaaacatttacaatagtattcaggacattatgtatgtggcaattaattttgttttcattgtttaaatattcagcactacagtcatcatcattataaatatacttagcatggaaaatagtcttaaatctaatccaagaatgttttatccacagtcaaattaaattctaaggcattttcttcagtaactgtacacaactcttaaaatcctaatgatttgatcttaatctgtgctaaagtactcagaccttccatcattcccatccatccctgtctaacgcattacttctcatcatccattatttaaatgttaccctataaacggtccccatgtcctgttgctgtccttctttcttatgtaatctttattctaccttgttatcttttatgttattcttgccccaggactgacaataaggaaaagctaccatcatttcttgtagacttgctccagtataattttttcaggcttgttgtcttggaaatgaggattgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacgcttgcttcatggatttttacatgtatattagacatatgctgggtatatgtgcgcaacgacaatctaaaaactgaatgataactagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggctgtggttgccgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgttgtaggaacagggaaattgaatttttcatagatttatgtgacacttgtatcatgttggggagagaggcatcaaaccaggctcattactgaaagaattattacgttatttaagagagaaagaactgtgaatttcttgtcaaatagatgtttaaaattcaaaactactattttttttttggagatagaatctcactctgtcacccaggctggagtgcagtggcacaatcttggctcgctgcaacctccctctctccatttaaagcaattctcctgcctcagactcccaagtagctgggattacaggtgtgtgccaacatacccagctaattttcatatttttagtagagacgggattttgccatgttggcccggctggtctcaaactcctgacctcaggtgatctgcctgcctcggcctcccaaagtgctggaattgtaggattgagccactgtgcctggccctactgatgtattaatattattcatcttcttgaatacaccaagtggtaaagtgcaaatccacactttaaacttgagatttctcctcctatgtgaattatactagtgaggaacaaaaaaattctctgttggtggggagatgatgtttgacagcggtcagtttgtgaagcagaggcttatgtcacaggactttttacagtattacatataaacatggtgaatggcctcaaacacagaagaatcagcttttttcatgagccatactaccaccaagaaagaactgaattgaaacctgtgactacttgatgaagggtgtataaagaagagggaaagatttgggaggccaaggcgggtggaccacgaggtcaggagatcaaaaccatcctggctaacatggtgaaaccccatctctattaaaaatacaaaaaaattagctgggcgtggtggagtcccagctactcgggaggctgaggcaggagaatggcatgaactggggagtcggaggttgcagtgagccaagattgcaccactgcactccagcctgggtgacagaacaagaatctgtctcaaaaaaaaagaagagggaaagaaaaatgacacaaaacacaatgtcataaatggaaaggaagaagtcattacacagcctacaggagtaaaaaaataaagagaggatattatgagtaattttatgtcaactaacttgacaaaagtggtgcagggcaggttcttggctacactcaggaaggaatgcagcgtaagctggtggtagaagaaaacagctttactgaggtggcagtgttacagctttgtgtctgttcttgtgaaacagagctaccacataggcattgtgccaagagcagtagcgtaggggcagttttgcagtcatatttatccccacttttaatgacatgctaataaaggagtgggttattcaggaatagctagaaaatgggcagtaactttcaggttttgccatggcaatggtaaactgatatggcactggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacggaaccatgttattaatccatgtgtttgcaaaacaacaaccttaagttttctgttttataaatggaggttgtggtgtcccccttttgtggctgtaggaccttgtaagaaacaggtttaatcctgggcagctgtacccaactagtggcttcctgaagcctaacagtaattaagagtaataaagaatatctgataatggctccttattctggttattattgattcttgggggatcattttgttgttgttgttgttgttgttgttgttttttgagatggagtctcgctctgttgcccaggctagagtgcagtggcacaatcttggctgggctcactggaacctctgcctccagttttcaagctattttcatgcctcagcctcctgagtggctgggattacaggcatgtaccaccatgcccagctaattttgtaatattagtaaagatatggttttgctatgttggcaaggctgatttcgaactcctggcctaagtgatccgcccatctcagcctcccaaagtgttgagatgaaaacgtcacaggagctgatgaaaaaggaaaaggagacagcaatgatcccaggcctttttaaagggagaacaagctgaaagcagcaaaatacaacagttaaatctctaagacactaatctcagaagttttaaaagaaactcattatcgtatcacaggcaaaattttttgttttacttgttttttttttttttttttttttttcttttttttgagatagagtctcgctttgtcacccaggctggagtgcaatagcgtgatcttggttcactgcaacctccacctcccaggtttcagccattctcctgcctcagcctcctgagttgctagggttacaggtacatgccactgtgcctggctaatttttgtatttttagtagagacaaggttttactatgtttgccaggctggtcttgaactcctgacctcaaatgatcctcccaccttgggattacaggcatgtaatcccaaagtgctgggattacaggcatgggccaccatgctcagccttaaagctgtatttttattaagtaaagtgtagaagaaaaagtgtaaataaagtgacagaaggaaaacacaaggctgttatggaaaatgataaccttagggcagaaaacaagaaaaggcaaaccaagatttccatagggtgaggctccaatccacaatcctcggatgaatgtcaatgctaaaaaccctggagcctccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcaggacagaaaataagataaaatggctgatggataaataaaatgtcattagaggagaaatgactaagagaaagatcaatgaggatgtagtcaggtgtgctatgggggacttcaaatggactatttagccaaaggccttatttcctggaccatctgacatagggcaggtgggtagatgggacacttacaggtgtgcaggagccaaaatggtgccaagcagtctctaacatgaggcctgcgtgaagatctctccaggctccccagcttgggtgggttgaactcccacgggtgaactggtgcatggagcggctggcctgcatgaagcagtggctctgtggccacttacctaactgctcagctccaccgcctgtcaggaaagatgatggctcttaaaacagcctttggccagtgttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaattatctcactgcaccaattttgccaaggtttgcagtgtactggtcaccaacttacccaaatctactgggacacaattcccatgcacaacgagtaacatgaagtggattactacctacagagagtcagtcagagagagcacaaagctgccggggcctgattgacactagactgtgcctaccccacaaggactgcagctgagggaccctggaatgcagcctaccctgggttttatgtcttagaatcacatgacacactgggctggagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttgattcatgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatataccacatttggattaccagttccctcctttgtgaacatttgagttgcttctacatttagctactgtgaataatttgcttctgtatgtggatatacaaatatctcctcaatttaatgtcttccattacttgggtatatgtccaaaagtggaattgctgaattatatagtatttctatttttaatcctttgaggaattgccatcttgtttcccacagcaggtgggccatttacatcaccacgacagtgtccacaggagttccagttccctaaattctcaccaagactggtcatcctctgttggaaaaaaacattctaacaggcatcaggtgggttttgtttttatttttctaaggattaataatattgagcatcgtttcctatgctagttatctaaatatctctaaagtatcttctttagggaaatgtctattcatatacttttctcatttttaaccagttattttatttttactgttcacatgtagaacttatttttgtatagtagatattattaaccccttatcagatatgattttcaaatattttcttctattccacatgttgcattttcactgtgtaggttttatctcttgatgcccattttaaatttttatgtagtccaatttaattttttcttcttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcatttttggtgacatggattgttgttcacatcagcttcctctggcaagtccacctggaaagcattatatttagcaagaaaaaaggaggctctgaatgatgtcactgtaagctgtttatattccctgttacaaatgtcaaatccgtgaagcataaagggatttactagaggatattaaattccttagaaattgttgaaaagccttaagcaacaggctccaggcaaagcctctggaacaattccaagaatggcactgctggcgcaggttggggaggagctcctgctgcctgagactccacattcaagctgtctcctgcaggaaagagagcagctcttctcactactgccccccgaaggacagctgctccgctatcaactactagagacctgacccctttctctgcagacctgcctgtgttgattacatcttcatttcagtctcatgtagattcatctgttttcatggattcaggggctatttctgcccaagtccaccctgtggctttctatcataaatacacatctttctacactcgaatttctagtcattactagtatcaacagcaacatgctagaacctcacataaagatttcctttacaaagaacatcatgctccccacgtagcattgtgctccccagaatgtggggaaagtccaatctgttcagcccaacaccatgtaggaaaaaaggctcttctctcatgagccgttaatctgtctacttattattaatttgtgggctaaactataaagactggtaaaaatagcacttcgaattcttttaacaaaagggtgtaaagaaaagattaaattatttaacatgcatatatgcatgactcatttcgttattgtcaccagcttctttcatatttattttattctctagtttctggcaatactttctctatggtagagtctggaaaggctactcctcatgtccttggcttcctaagtcccagatgtggtgaagaatgcccatcagctgtgttactacggagtgcttttggattgagatgagggaggggaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataactacacttctccatgtttaagctgaccaggatgctgtccctggtgtttacacctccatatcccactatgcgtttcatcttctctttgcctcactggtgatccaagtacagggaatgcttcacatgactgtgatccctagaacttcgtcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactctatctatggccccagcacacacgctaatgccctgtcttgacaatttatccagtattttaataaatgtaaatggtcacatgcttatcatatcatttcttccaatttcatggaataatttcacatcaactctttggattaagagccgtcaaccaaaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcacaagggtttgtgtgccagctttgcttgactaataatgggtttttctctgtctatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgagccctgatgtgtggcgcaatgttaggggttcaagagacgtcattcttcttgacaaattaggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcgcttggaaagcatgtttttattttggctcatttttgaaacgtctagtcatagttcttcctgaaccactttgtctgcaatcatcctgttgcatttcttttaagggctgatgatctgtcaaaagcaacagccaatattattacattgctgttctctttgcaatgttatcatcagatgtaacccttgcagattaaccactgttacgatttttacatttccagggatttcttgacaatggcaatgatgtgacgccatccagcatctatttgtgagaactctatttgacaaatcatcactgtgggtgtgaacataatggagactttcataggatgcaatggttaatattcaacattagtcaaaatttactctagtcctacccttggagctctactgggttggaaaaatattttagataaggacaatcatttcatagagttttaaaaataaaggctaaaataaattttctgtagcaagagtatgaactatatgtagccagcatacccttttttagtggcatataacaaaaattatttaaatgtatttaatttaaataattgtataaatatgcatatataataaacatacttaaatataaatactatacatgtatatttgtagccaacattttatcagataaatatatgtaacttttatgtatcttatatacatatatgcacattttccataaataaggtaaattttaattttttattgaatactagttttaattttgtctttaattttctcttaataacttcataatttaatactaaatgttcacatttataccaccaacttaagaaaaaatcgtgtgtgtaggtagaggtgtaaatactgtatcaggaagcttttatgcattactgattggtaactggttaaatccacaactcagtggctgataacagtaaacatttgttttcgtgttcatggatgctcatgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaacaaactgcacagttgaatttaagtccaataacttctaacatagcttcacatattttaaatatattcctttatttcaatgagtacaaattttgaagaaaatgtttactccatttaattatagaggtatttgatcattccatggacaaataattatgctttcaacttttacaattctgaaaatacttgcaaatgtaaatttgcattaataagaaaataaagctggatgtgttttcaacatgtagctttaagtatatatatattttaatggcctcagtgggggaaaatcattttaacttatgtaaatatccctttttgcctctcttgtgtcctataaagttgcccaacaagaggtcctcccataagatttggaaatcagaaaaggatgactcaatattctccattggtacctaaggcagacacaggaacagaggtgagggctggagaaacacctggaaggatgctgcaggaagctgagaacatcaacactcccacccctaagcttccagacaggactgaggaccacatggttagatagcccatacttcaagggcagatgcattctgttttctgagtgagcgccattcaatcctgcttctaatatcaactttcctgactactatatccttggctttgaaaggttgtagtctgaacgttaatcataggcatcggttcattcttgttatacccaaaagagccaagacacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcaggcctcgtagatactatcaaggagctgaaacatacatatcactgaatccggacactgagacatcagaaccttcacccattatgattgcataactgacctcttgcttcctgttgaccaaattatcttccttacccctcccaaattcctgttttcccacattttgtccctgttatataaagtcttaattttagttggtcagggagatacattcgcaaatggtgtcccatctcctcggctgcagtacctgattaaagcctgtttcttggcaatacttgttttagagattggctttctgcgtggtgagcagcagggtgtacaatgaatccttggcattttagtaagaaaattctctgcaaccttcactgctttggcttcttgtaacctgaattcacatttaactgcaacttctgagacaacttgatataattgatataattagtgaatcctaattcactttgtccaccactgcttaccagtctgagcttgccagctcccaacccttactagtgccagtgaactttctgaaaatgcaaaaggtaatattttccctttttcataaaacactaaccttctcttcgtacttccaatatattgaagaccactgagttttcctgtgtgtccaatttggcaaacatttctttgcaaataaaacatgaaatttagagattccgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattaaatcaggagaggcattgttatgtctgtgcagctggggcttacaaagaaaaaggaattgggttgcagaggtgatttcaggtccccctctaccaacaccatcagagtgtggttgcatctgaggaacactctcaggcgatggaggcatcaggaggagcagctggggcagcccagcctcacacatttgcttccctgggggtttttgtttgggtgtgtaacactgtgggagggtaactataatactgttgacagtaataagttgcaaaatcttcagactgcaggcagctgatggtgagagtgaaatctgtcccagatccactgccgctgaaccttgatgggaccccactttgcaaagtggatgcagcatagatcaggagcttaggggctttccctggtttttgctgataccaggctaaataactgctaataccctgactcgcccgacaagtgatggtgactctgtctcctgtagatgcagagaatgaggatggagactgggtcatccggatggcacatctggcacctgagattggaaacataaaaacaaatgtccatacaattaatcatgttgtaagagaacttccctgaagggccaggctgtaccaagcacactgggctgagtaaattcctagtgttctccttccttacctgggagccagagcagcaggagccccaggagctgagcggggaccctcatgtctatgctgtgtcctgacagggtctgactcctgcatgaagtgtgtccagcctattaataagtcttcagggcaggaggttgagcaggggatggggctgactgggcacagctgcagggctggctcatctcagtaactcagcaccagctcagtatccccaggtgtcccaggaaagaccagggtagcacaaatttgtctgtggtgaatgtgtttctactggagagtagtttgttatgagaaacattttttatgtatttttttgaaaatttgaaatattcctcaggagtcgacggagtaatgtatttcattggcacatggggattatttggaatatcttgtttgtaggaaatacatagtaaaatgttaaacagtatgattctcaggacttcaaaagactctcatatgattcgggttagggaaggaggtactttgtcctatacttcaacatttctgtgagttttaacattgttcctttctaaaaatattaaaaataaaatttattgacatgatgctatacatatttgtaagtattaggtaatggtgttatgccattgttcttaccactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttacgttttatcagggacatcatcctgacccagacaccatcctccctgttaacatctttaggaaagagacaatcccttatcaagcaattgccaacttacatggagaaatcagctggatccagatgaaactggacatggatttgcagtcattatatctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccatgcacaaaccttcctgctgctttgtaagccacctgaattttaagggaacttgcttatattgggagaagggaagaaagctccatttgtcctctaaatgtttgctgaaaatgaactgacaaaagaaagactaataagagaaaaggcaagcaaaattcacttaaagtgcagtgggatatcatagcggtgtgattactcagataactcaatgagatccagttgttcatacttcctttctagcgaagaggtaattgggaagtgtaggcaacctggagagaatagatgaggatagaagtgcatcctcaaaagaacaggtaatagcctgtctggataaagcatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgccctcttgcttcataaaaatgctttgttattttttaaattttactttaaagaaggacaattttggagaatatattaatttttggtggaatgaataatgtccccaccccaaaagatatccaggtccttgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttgcccctacatgtgcctggcaacatggctgcccccacatatccccatgtgtgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggagttttctctttgttggaatcccctgtccctctgtctttgtacagggtagctgtttagctgttttattcttccttccttcttacatattaaacttttctctccttaaaaccactccacatctttctgtggcattttatccaaagcagtgtgaaacagcaagaaccctggtgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaggattgcagtcagagaggagctgggacaatggggacggatgttgtttgaggaaggaaggggccatggaaccagaaatatgggagcacattgaagataagaagcagagaatccagttctctcctctggagcctccagaaggattacagccccactgacaccttagcattagctcagtgagacttctgacctccagaactacagggtaatacatttatgttgtgtgaagccaataagactgtggcaatttaaacagcagcgttggaaactaatgcaaggggaagagatgtctttcagctcactgagagcatgcttgtcctctgttcttggaaatatttccaccttgttatctggtgtcagacaagagacagagaaaattttttctgagagaagagctcgtacaaaaattctttttagctagaaattctctttggaaaatcccatgattatctcttatacgatctgggtatcacagagtttaggggtcagaactcacagcacatgataggaggaagagggttttgttagtttgttttcatattaggagggaaaattagattttcaggacacaatctgagagggacagactgggacagggatattgtaagagaaagaggagatgtggaaggtgtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgtattgtggagctaatcacatgtgccttaatccctgctcctgtcccgggctgggagaggctcactgtcctcaccatgcccagcaggctagagctcatgccctagacaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagatgccaggcactggccctgggctgtggaggaagcagctgctctcctgagccacagggctgagaatctgggaggaaccacaggccctggccacagggctgcctggcagggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctggtgctgaatgactgggaccctgctggagccaaaaacggacagtcagcaaatgtccttaaagtctttactcagccagactctattctgcttggtcagaaaagaaacacacgctacacaaataagcataaaattatatgtatctgtaatatgaatttctattgtgaactttacatattgaatacatatttaagaaataagttgtatttatatatttgtatatactatgtatttatgaataaatatgtgatgcatgtttatatataaagagatataactttggttgctagtataaggtatagttttaaacttaaataaatttaacatgaacattgaaaatgagcactgggtgcaccacctcatggccctcctcactccaggacctgagggtcataaagctcagtaccctcttccatgttccccctgggctgagagaagtgaactgcccgttgctgaggatcatgagtgacctgaggggggtctacggaatcacagaacagcagatgcccaggaaatggatagtgggtctgggccctgaatggagggacgttttgtttccagagctcagcatagacaagtcctcctctggtcatttctgtcaaacaaagcagcatatatggctcagaggctgcattgtcacaggatgaagcccctccatggctcattccagcttcccctctgactggggtgatgtgggatctctgcccagctttcatggctcaccagctgctgggactctgttgacaatggcctatgtctgccccatgcacaagcttctcaatagttgccattttactttctggtctccaataaccacaacttgccaaccatgacccttccacaaagattcatagagtggggtcagaactatgggttcagcaacgtgccggggcatgcaggtaagagacacaaggcgtggccagcccgtgtctgaagtgaggatgaatttgcatcatgaattcagagtaggagatgggagaaaacatcctgacatgctccaggcagtgatgcccacaagatacactagaggtgcccatagaggaggtgggaaggggatttcaggcagaggggatgcgaatttagagatgtcccccagcctgttcccctgagaagatttcagacacttagtagcccctgggcactttgagagaccgaggagaaaggaccatgtaaggccaagaatttgatgccagcctgggcaacacagggagaccccatgtctacaaaacacacacacacacacacacacacacacacaatttgttaaaatgtgtgaaaaatagcatcacaaagtgattatgtatgaacatttgctcagaaaattagaaaacaaagcaatgtcttctgagctaacaatactataataaagatgtcaattttttagctatagtaatacagagaacatgatattgtctatcttaaccatttctaagagtgtagtgcaatgccattaaatatattcacattgctctgctattattactgatactaaatccagaaccattttcatctgaataaaattaatatctatatcctttaaacaatactcccccccatttcctctatccctaccgccagcaacctccattccagttctgtctctatgtcattgacatatttgaagcaggttcactctgcactggttaccaacatacttgagtgtggggaacacaacacccccacacagcaagttacatgaaatgggtttattatttacagataagcagcaagggaacaccacaaaagtcttggacttattatgggtcagtccctcaaggcacaggaaagccatgtggagctgatggagttgactatgtgtaccccacatgcaccacagctcaggaatccaggaaagcagccactcagggttttatatcctgagctaagaagacacacagggctaaagtgctaacggacatcctattctatgggaaactggtatagagcacaggtaggttgttctgctcagttcctctccatctcaggatgttacgattccagcaaattctacaattattcttgagaactcataaaataagcaagaaagtggagagaactaagtcagtccagggtcattggagaactgttttgcaattaccccaccacctagacatcccccttagcaaagctagcatatttcatatgcccaccaacttcccttgaactggaggcagaagtttatcttttcagattgatgaagcaccttgactaacacaacttcaatgcagattatgaagccatagtgagagtacatttcactgggccacgaaaagctagtaccactggtgtagggtccagccctgtggggcttagtgggggttctccccatgtgcagagatgagagattgtaataaagaaagacacaagacaaagagataaagagaaagcagcttggcctgggggaccactaccatcaagacgtggagactggtagtggctctggacggctgggcacactaatatttattacatacaagacaaggggggcagggtaaggagggtggatcttccaagtgattgataaggtgaagcaagtcacgtgatcataggacagggggcccttcccttttaggtagccgaagcagagagagagaagacagcatacgtcagcattttcttctacgcacttataagaaagatcaaagactttaagactttcagtatttcttctaccgctacctactacgaacgtcaaagaggaacccggagtatgggaggaacatgaatgtggacaaagagtgtgaccattgaggcacagcaccacagggaatggtttaggcttccggatgactgtgggcaggcctggataatatccagccttccacaagaagctgggggagcagagtgttccctgactcctccaaggaaaggagactccctttcgcggtctgctaagtaaagggtgtcttcctagacactggcattactgcttgaccaaggagccctcaagtggcctttatgcaggtgtgacagagggctcacctcttgccttctaggtcacttctagcaatgtcccttcagtacctgacactatactcttaggttattcctaggttatattagtaatgcgacaaagagtaatattaaaagctaatgattaataatgtttataatagtgattgataattgtccatgatcatctctatatctaatttgtgttatgactattcttattctaactattttctttattctactgaaacagttttgcctgcagtcttttcctcggcacctacgtaatctttcacacacacactggcaggagggtaagactccccaaagcagtgactaagatgttaagaagtgaaagggggatctttcagatgccctattctctgcagccagtgggcctgctttaggatcacctctacttgtatttctagaatacccgaggtgtttatccaggcacagcaggtagtattgggtgttggtaattgcgtggaaagtctccgttgggttcctcaagaatgtgcccattgtcatgcggattgggcggttgtttcttggtcagagtgaagtctcatggggtatccaaaaacatgacataaattcctttcaaaggtcaccatggtagccccagcatctaactgagtgacatacatttagctgtccaggaagcaagctatggccatagtccttttccctacacaggggatcctttaatagttctgccactcagttgctattttcctgaccagatggctgggttgttggcaatggcccatgatttagtggaaatggagcaaaatatagtgttgggggcagcctgcatggctactatcattgcatgaagtttggcccactgggcagaatgtccatgttcagtgtcagtcaaaagatgccatcccctggctggatggtggcctcacccagtggacccactggcatgtattttgtacaatcatcagggccccatgccatactgacataggcatgtctctgaatcgttggctcattgtggccaaaggaaaaacaaaattgtcccctatgggtcatttgttcccttctaggaagcttgctatttgtttatgggcattcatccatttgcacatggatcctgtgggaactgggttagggcgaattctgactgtaccagttccatttaataatttggatctgttgggcctgtccagttttattgattgtgtttgtaggcaccaaagtgagaatgggtagttaaggtagcagcgtcatccctgatgctctagctatgagataatcagcccctatcagtttcctacagcaagaagttgccattcaaaagaggcacaactggtggcttctgttgccacaggctccagtcagcatatatagaaatagtggacacctggatttccattgagcaagcagcctctgaaggtcttaaagaagtgcctcagtcatgccttgttgaacagattccaagggtgattttgactaacatgaccaaaagaacacccaggtaaggtttctactgtccccagtaccccaaaatacctactagcttctgggtctccatcttattagtggacgccaccaggaccagcaatgattaaatatacctgggatacctcctaggtttctttttcaggtggccttggcattcagccttcaacaatccatcattggtctgccaaactgggttgttccattgtgacaccaggctttgtgacattttaatctttttgtagcaactattaaatttactaggtagtgttccgatcttcactgaatatgcagtcctgctttgtgaacaacactctgggacacgggaagcttaggtggcaggcaggagtggatatgccccactgtcgtgtcttgaatacttagctatgagtgcggatagcccctcaggcagcagtgatgttttgtggcacagcagcaaaatgtcagtacctctattgcactctgcagtgagaaccatggtcaccagcacccaacatagcccaaagggtgtggtccacatgcagatcagcacacaagcacatactcaccatggggtcctcatttgtcttgacaccttctgatgtcttcagtttatttttttccagggaggacctggtaatattgtcaggtggattgcagcatacaaaaatcccagaatagtctgaattcttttttttttttttcaccttttatcttgagaggaatatagggctggtagcctctggtggagaccttggccctgttcctacctgtgccattcagacagacatttgggtctgcaatgtggcttaaccaaacaaacacaccgaccaggctgcataagacttccctcgtgtttttccatgtctcttttatagagagtgagcctccttttctgtgatggccattgttgttcattttggttccttatcagatgcttcagggaccattgagattatctttcttgtgtcatcttgggtgactcagggtccatctgattacccatgtcttgagctctcttgcctcaggaatgagcaatcatgcaactgtctaacaactagaaaattgtgtaccccattcctatttccacattcttttttctatgtctcaattcagtcagccagctgatccatattaatgggaggaggacaaatgtcctgtttatcctccctcctcattaaacatccatctgcatgtccagcccttgcatctccaggctgatatctctgtcctgggccaggtactggagagtattgttcctccaacttcaccataagccatagttctctcaaatcaaaccttctcactgcaccaattttgccaagaaggtttgctgtgcactggttgccaacttacccaaatctagtgagacagaacacccatgcacaaccagttacatgaagtggattactacttacagagagtcagcatgagagagcacaaagctgtcagggcctgattgactctagaccatacatacccaacaaggactgcagctgagggaccctggaatgcagtccaccctgggttttatgtcttagaatcacatgacacactgggctagagtgttgagggaattcctctttgtagtagggacagaaacagagcccaggatattttggccaatcttgttctagctcagaatgctacatttccagaacattctacagttattcctgaaaactactagcaagaaagggaaggagactgggttgattcatgactaaatggaaacttttctgcaaataccaaagtgaaatcataactcggtatttttgagactgggttatttcacttagtgtagtgtcctctagttttatccatgttgtagcgtgtgtcagaatttccctcagtaatgtgcttttgtatgtatataccacatatggattaccaattccttcctttgtgaacatttgagttgcttctaccttttggctactatgaacaattcggttctgaatgtgggtatacaaatacgtcctcaagttaatatcttcaattacttgggtatgtgtccaaaagtgtaattgctgagttatatagtatttctatttttatttctttgaggaattgccatcttgtttcccacagcaggtgggccatttacatcaccaagacagtgtccacaggagttccagttccctaaattctcaccaagactggtcattttctgttggaaaaaaatcctaatatgtgcaaagtggggtttgtttttatttttctaaggattaataacattgagcatcttttcttattctagttatctaattatctctaaagaatcttctttagggaaatgtctattcatgtacttttctcacttttaatcagttattttatttttactgttgacatgtagaaattatttttgtatagtagatattattaaccccttatcagatatgatttaaaaatatttttttctgttccacatgttgcattttcactgtgttgattatgtcttttgatgcccattttaaatttttatgaagtccaatttatcttcttttctacctttgcctgtattttggtgttaaaggtgttagtatttaaatgtctatacatactgacttactatactgagaaggtcacactccaccatctctctgatggtggagctaagagttttacactctcccattttgtaccaggggacagtgcagctatgtgagaacccagtgactttcccgagcttatttgtcttgcatttttggtgacatggattgttgttcacattggcttcctctggcaggtccacctgaaaagcattatatttagcaagaaaaacaggaggcagtgaatgatgtcactgtggattgtgtatattccctgttgcaaatgtcaaattcgtgaagcataaagggatttactagggatattaaattccttgcaaattgttgaaaagtcttaaggaacatgctcctggcaaagcctctagaacaattccaagaatggcactgctggtgcaggctggggaggagctcctgctgccttagactccacattcaagctgtctcctgcagaaaagagagcagctcttctcactactgcccccagaaggacagccgctctgctatcaactactagaaaactgacccctttctctgcatacctgcctgtgttgattacatcttcatgtcagtctcacatagattcatctgttttcaaggctgcagggtttatttctgcccaagtccatcctgtggctttctatcataagtacacatctttctacacttgaatttccaggcattactagtatcaaccacaacaggctacaatctaacataaatattttctttacaaagaacatcatgctaccaatgtagcactgtgctccccaaaatgtgaggaatctccaatctgttcagcccaacaccatccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttccgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacacggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccatgaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattccatttgctcttgctttatatgaactagacctatggccccagcaaacaaactaacaccctgtgttgacaacttatccagtattgtcttaagtctaaatggtcacatgcttatatcatttcttccaatttcttgggataattgtcatgtcaactctttggattaagaatcatcaaccaggccaggcgtggtggctcatgcctgtaatcccagcactttgggaggcagaggcaggcagatcacgaggtcaagagatcaagaccattcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacagtgaagccgagatggcgccattgcactccagcctggcagcagagtgagagaccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacggttaatgtttcagagcctccaccacttctgatcgtatagtaattcaacagcacaagggtttgtgtgacagctttgcttgactaataataggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataagaatggcaaattcatatataggaaaataaccagtgctttccttatgttacatgaggtccactagtatcacctaataccagctgttagtctgagccctgatgtatcatacaatgttaggggttcttcttgacaaattagatgttcagaaaagccggtagccctgtaggtctcagttagttgaaagtcatattattgagccccccagagacctccataacattggttcatgatactccctgggaaagctgggaaaggtgactgactgaagtccatgtgttgaatcatcctcattattaaaagccccctgctcattaatggcattttgattaatactcacttggaaagcatttttttggattgtggctcatttttgaaacatctcatcatagctcttccagaatggctttgtctgcaatcatcctgttgtgtttcttttaagacctgatgatctgttaaaaccaaaggccaatattataaaaatcctcttctctttgcaatgggatcatcagatgtaaccttacagtttacccacggttaggatttttacatttccagggcttccttgacaatggcactgatgtgactccatccagcatctattgttgtgaggactctatctggcatatcatcattgtgggcatgaacataatggagattttcacaggatgcaatggttaatattcaacgttagtcaaaatttcttctagtcctacccttggagctctactgggttggaaaaatattttcatgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatatgtagccattttaacaaataagtatatatttatttatacatatcttacatacatttatgcatatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaataatgtatcagggagcttttatgcataatgattggtaactggctaaatacacaactcagtgactgataacagtaaatatttgttttcatgttcatggatgctcatgttcacaatcatctggctgatcaaggaagggctcaggtaagtggtttctctgcatggcactgagcttgtcttcagcctatacatattaattgtcttaggacaaggctgaacagcagtgactacccatgactcaagattcttctggcaggtcacaagagtgaacaacatcccaaaccaaactgcacagctgagtttaagtccaataatttctaacatagcttcacacattttaaatatattcctttatttcagtgagtacaaatttttaagaaaatgttcactccatttaattatagaggtgtttgatcattccatggacaaataactatgatttcaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcctatagagttgcccaataagaggtccttccatgagatttggaaatcagaaaaggatgactcaatattctccattggtacctaagacagacacagggacagggatgaggacaggagaaacacctgaaaagatgctgtaggaagctgagagcatcagcacccccacccctaagcttccagacaggactgaggaccacatggttagatagcccatactttaggggcagatggattctgttttctgagggagcaccagagaatcctgcttctaatgtcagctttcatgactactatatccttggccttgaaaggttgcagtgtgaacgttaatgtaggaattgggtcattcttgacatacccaacagagccaagaaaccaggagggaaagacactcagggtgtaaaatattgtctgaagaatgcaattgaaataggccctattatcccatggaagtaatgtttatggttttttgaataaacatagaaattgacttccccagtcttaaaactcaagttagttacatttgtcttatctgagttcctttttcaggaaacccaccaagaggcctccagatactatcagagagctgaaacttacatatcactgaatcaggacagtgagacgtcagacccttcacacattgtgattgcctcactgaccttctgcttcctgttgacaaaattaacttcattacccctccctaattcctgtttgcccacatttcttccctgctatataaccccctaattttagtttgtcagggagatacatttgagaatggggtcccatttccacagctgcagcacctgattaaagcctgtttcttggcaatacttgttgtcttagtgattggttttatatgtggtgagcagcaggatctacaccaaatccctggcatttcagtaacaagattctctgcaagcttcactgctttggcctcttgtaaccggaaatcaaattcaaccccaacttctgaataatttaacataattctaggattcagtttgtccatcagtgcttaccattctgagcttgccagctcccaaaattttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatagtttatactctatttctctgtatcaagacaattcctgcttagaatatctatagtggcttcttctctgttacttgaattccaactgaagccataaactagactcctcaggtgtcatgatccctgccttttttaaatcaggagaggaactgttatgtctgtgcacctggtgctgagaaagaaaaagaaattgggatgcagaggtgacttcacatccccctctaccaacaccatcagagtgtgcctgcatctgaggaacactctcagctgatggaggaatcaggaggagcagctggggcagcccggcctcacatgtctgcttccctgggggtttatgttcaggtttgtaacactgtgggagggtaactattaagctgttgacagtaataagttgcaaaatcttcaggctgcaggctgctgattgtgagagtgaattctgtcccagatccactgccgctgaaccttgatgggaccccactttgcaaagtggatgcagcatagatcaggagcttaggggctttccctggtttttgctgataccaggctaaataactgctaatgccctgactggcccggcaagtgatggtgactctgtctcctacagatgcagacaggaaggatggagactgggtcaactggatgtcacatctggcacctgagattggaaatataaacacaaatgtccatagaattaatcatgttgtaagagaacttccctcaagagccaggctgtacggaacacactgggctgagtaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaatcggcagggggtggggcaggctggatacagctgcgtggctggcttatctcagtaactcagcacaggggcagtgtccccagtgtcccaggtcagaccagggcacctagatttgcctgcagagaatgtttcttcctaaaggatattttgttaccaagtacatttttgagcatttattggcaaatctcgaagtggttgtgagaactagatggaataatatatttcaatgccgtattgggcataagtaggagaatatccttgtttgtagagaattcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaagatgatattgggattccttaaagcatatgacatccacagttcctgcattgtccagagctataagtctctttaatgctcgagttttaatgggattcattttattctctgcttggggacccccatattctacccccttttctgtcattgtgaattatttcccatggtccatcagcataaaagtctgactagcaatgctaaatctgattactttaaaacaattttttttcttcttctactacaggagccttgattagcataaacttgaatctttgtgttagtttgcttaggataatggcctccagcaccatccacagtgttgcaaaagacatgatctcatttttcatagctgtatattaagtattccatgttgcatatgtaccacattttctttatccaatctacaactgatgggcatttaggttgcttccacgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgctttttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatacgctttttggccgttaatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcatggatatatatgtgtgtgtgtgtgtgtgtgtgtgtgtgcatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaattctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagatgcatcagtgattgtacaggcatctctgacacctctggagaaatcttgttagctcaatccagaatcttacctgagaaatgttttgagtctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccatgtggtagagggcacatccactatttcaattcagggtttgtatgcctatgtgaattacaccattaaaaacacagcaaattccatattggttggggaagaatgtttgaacagtaatcaatttcgtgaagaagaggtttatgtcacagcactttccacagtattacatacaaaaacagtgaatgatctcatatccacaagaaccagcatttctcatgtgccacatatgccctcccagaa

SEQ ID NO: 826 - DNA, 59643 bp, Homo sapiens
ttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttatttatttatttgggtttgggtaaaacttaaccatatgtttaacaggacctggactttgatttaagcaaacttagggtaaagacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacaccacgttttctttatccaatcatctgttgatggacacttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacttggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaattttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggttcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataatgagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagcgaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagcggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagtgtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactattttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttgtctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttacgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctcatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactacccaattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataaaaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcatcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggt

SEQ ID NO: 827 - DNA, 63682 bp, Homo sapiens
aattttctatacttgccaccttttttctgtttggtgtcctcatgtaagtctcagtgttacgatctgtctccccacctcaatcactgccctctgtctctggaaggaaattccccttgggctgaggccagcatggtgccagacaggagagatccagtacccactctggaaaatttcataagataactggttctccaccttcttcagggaccttttatcatatctcatgtgcccatggcatttgtcactgccatctgcacaacactgaactccagcaacatcaactgagaagaaagagagagagagggagaaagagaaagagagagagagaaaagtcgtttgttgattgagccacacaaaattttttttctaattaaattatatatccaggtagctgcaatatgctacaatcccaaatacacatatttattaaatatgattcaaagagcattcattgagtactctgtatcaaggcacaatgtaaaataagtgcaaaattactggtgattgttacgcctttctgtgggactcgactctctctggttggaggtactgtgtgggagcacgtgagctccaatcaggtggtctggagggagcaaaatgcagctgttggaggttaaatatgaagggaaatagcagtaggcatcggatagcatagaatgaaaataaaagtgcatatacttccagtgcctgttttacagattccttgtctttttttttttttttgaagacggagtctccctctgtcgcccaggctggagtgcaatgctgtgatcttggctcactgcaacctccgccttctgggttcaagcgattctcctgcctcagcctgctgagtagctgagattacaggtgcgcaccatcacgcccggctaatttttgtatttttagtagaggcggtgtttcactatgttggtaaggctggtctcgagctcctgacctcgtgatccacctgcctcagcctcccaaagtgctgggattacaggcatgagccagtgcgcctggcctccttgttttttaaaactagttcaaaccctcaactcataatttgggaaattcaggtcataggatgccctgttatttataaggtatccagcaatgcatggaacagaatatttaacttttaaaaaacttatattaggttgttgcaaaagtaattgctgtcattttctcctttctttttctttttctttctttctttctttctttttctttctttctctttcttcttttctttctttttctttctttctctttctttcctttctttcttttctttctctttcttttctttcctttttctttcttgtctttctctttctttctctttctttttctttctttctctttctttcctttctttcttttctttctttctctttctttcctctttcttttctttcccctttctttctttctttctttcttgtctttctttctttcttctttctttctttttttctttccttcttctttccttcctttcctttccttccttcctccctctctccctcccttccttccttttccttccttccttcccttccattcccttcccttccccttccttccttccctccctccctcccttccttccttctctctctctttctttctttcttcctttctttctttctctttcctttcttctttcgttgttgtgttccagaacgatttagtgttacctacagttcccagagaaagaatcctgtcttgaggggtggctggggcagggctactactctccctgctctgtgctctagtggccaggtggatcagctccagctgccaggccaaatttcctagggaatggaattctgtctttttaacaagaacaaaataggtgcttagtaaatataagatgccttcagcttttagtatatgcataatcataaatataaatttgtttaaaacctgaactattctgatgttctcactggctagccaaacttaaaatgtgtatttggacttgaatttcccaccaagggtgttactagcttctttactgttgcagctgccttttgttttgtttttgaaagtttaaaaaaatacacaagggggcttttgcttcctgaaagatggagtagaattacttttacctatttctctcaagtaaagtaaaaaccccggacattgtacgtaaagcaaacttatgaagactctggaagctggagagaagaaggcagaccagttaggaacattgggacccaaggagcgacccagcagtgcattccacggggtttctttttgcctcatccattccagacttggttctggagaagtttgtcaacccagaaacaccaacaggcccagaaaaacataaagccctaataaaaagctggctctctctagtcaaaggagaaagaaaggggaagcccagtaaaacaattcttaggcagtaacggctctgctccattcaaacacccaacttctccttcctgagtggcaagagaggaaattcgctgagatgagtttaaatgagatccaaagcctcataacacaatactccaaagtccagatttcaaatgaaaaccacacatcccaacaggaaccaggggaaccaggaaaatctcagctttgatgagacagttaagaggcgctaatactgacatgacagagacgttagaattacctgacaagaatgttaaagctgccatcgtaagaacacatcaaactcaacaccaccatcaatgagtaagatcataaatcaacatttctggaaaactccaaccagcaccagcagaattcgcattcttttcaagtgctcatggaacatataccaaaattgccatatactgggccatgtaacaaacctcaacaaatttaatagaactgaaatcacatgaagtgtgttctctgaccacctggaatcaaactggaaatcgataatagaaaaataatgggaaaaatgccaaacccttggaaacaaaacaacacacttctaaacaatccatgggagatttcaaggaaaataaaagattatatattgaatagaataaaactgaagatgtaacatattataatatcaaggatacagtaaaagcccaaagaaatgaaaacttatcccagaaaaatgaaaacttagcacaaaaacgtatacaatacacaactattcatagtggttttatttgtattaaaaaaaaactggaatcagtcaaaatgtcctacaatagattaatggtaaaacaaactgcggtacatccatcccatggaataattagtaataaaaagtagtgagttgggcacggtggttcatacctacaatccatacctacatacctacagcactttgtgaagtagaggtgggagaatcgcttgacctaggagtttgagaccagcgtaggcaacatagtgagaccatgtctctaaaaaaaatttaaaaaaattagctgtgtgttgtgtcccatgcctgtagtcctagctacttgggaggctgaggcaggaggaagcttgagcccaggagttcgaggctgctagagagagttatgatctcgccactgcactccaccctgtgtgacagagtgagactctgtctctaaaaaaaattaaaaaaaaaatagtgagctgttgatacacatgacttgaatggatctgaggggcattatgctgagtataaaggtcacatattgcatgattccatttacataacgtttttgtcttttcaaaaatattgcaaggggtacttggttgcagggtgtgcgcatttttcaatttacaaattggcctcaaattcgtgtattaagtttcattcccacatttgcaatgataagtcctccatggagtttcctcactctacatcctctccaatacttgatattatcaggctttttaatttttttccactcaaatggtcaatacgttgtattttatttttggtttaaaatacatatttgtgttttctgatcactcatgaggttgaccatttaaaaatgtttattggctattggggtctcatctgttgtgaattgcctgtttttaaggtatgcccacttttttattgagtttcttatttttttcactattgcataggagttttcaatctttcttccctcctcttattctttaataacagaatcccaatttttttacagggcaacagtgtcccagccaaaaatctaattcctcagcttctttgcagttaggactgttgagacatcatctgaaatctattgtgcatttctggaaaaattttgcttgatggacagaggcaccactgcttatttctcctttgtgttctatcttcttctatctggaacttggcagaagcacccatcttgcaggatgaaagtcacaagctagagtggaggagcaggcagggaaaggacctgggtcctgcagcagctgtctagctctgaaccacctgcctccagagtccgccttggtgagaaaaatgtatctctttatctgatcaagctcctctagttagatttcaactacatatagctgagtgaatactgatgaatactgaataatgaatgctggtacaactttctaatatcttctcttagagttctgcattgaagtttttaaataagtttagtctatacctttcttttccattttcagtcttcaattttgacttcaagataattctagtcctatgatgtgatttatgtttctaaataatggcatttaccctctttcactattccctggaattggaaaaaataggttatttatttatttatttatttatttatttatttatttatttgggtttgggtaaaacttaaccatatgtttaacaggacctggactttgatttaagcaaacttagggtaaagacagtttaaagacaatcaaggaaattggaatagaaaatgggtattggatattagggaattactctcaattatgctgggaatcataatggaatggtggttgttttttaaaagtccttatcagttggcaacgtattaatgattggctgaaaaatactgccagtgtctgtgtgtgaggaggtgagagaacagagtaattggatgaggggggaggcggtagttgaaacaagattagcaaaatgttaatttgtgaagcttagggttcattatactatttgtgtatattcatatttctataaacactaaaaatgaaaataaagtggtctcgtgttgctgactgtgactgtcacactctgtcagcagatggcagtgttgtataaaccatgagcctacataggcctaatggatcattgtgcttgctaagtaacaaaatcaatgatacgatataaaccaggtcagattttattgcttttagacaaaagggcaaggtaagatttgcagagtaaagaacaggtacagagtaataataaattattttaaaaattctaagtgattcattaaagtcttatagacaagttgggtagaaaagtacgtaaaaaccccataaacctataaacttactagaattataaaatcatttggtctctctctctctctcaaactctccccttatttgcattttaaatcagtattttcatacatatatatttgcaaaaccttattgatttcattgatgaaaatgacttggagtttgctttaaaaccttacacgataaacataaatattattctgtagttctttttacccaacttttaactggcatagtttaatctatgaaaacagctccatattttaaaagattctctaactatgacaacaggcaacatttcatagatgataaaatgtcttatcaactaatacctaatattttaacttaggttatgtacagtagctttaagaaccagttgtagaatttgatatatagaaaataatatagaccctgtcactgggcaaacttatggtggaatcattttttgtgttgttgtggacaaattagttattctttctgaacccctgtttggatatatattttttaaagcccataatttgggcatcctcataaagtagtgacgtctgaaattaaacaatcaatgtaagagagctagtttcctttctcggcaagagaatatgactctaaaatttatgcccaagttagactatttttatcttgcctctttcccctagaatatttgggtttaattaaaaatttacaatgaaattagaaaaataaaaataaaaatcgaaaatcaaatggagataaaataacagtggtaatcaaaatagacccctattttgatctaaaaaagaaaagaaaaaaagataatttggacatcataaaattaaacttctgctcttcacatggcacgttaagaaaataaaaggcgccacacattgggagaacatattcataaaacacaaatgtgagaaaaaaatcatatgcagaatatacaaagaactctcacagtccatagtaacaacaccccaataaaaacttgaccaaaaatttgaaaggatatgtcatcaaagaaggtatatagtgaagttaaaatactaggctcgagcaagtggaaccctcattcactgctgatgggagtgcaaaagagcacagcaactttggaaaacagtttggcagtttcttataaagttcaacatacacctaccagatgactcagcagtcccaaagctaggaatttacccaagtgaaatgaaatcctgagttcacacaaaaacctgcattggaaagcttacagcaactttattcttagcagctaaaaattagaaatgaccaaatggctttaaattgttaactagataaacaatctgtggcatatccacacaatggaatactactcaacaatagacagtgaactagtgctacacgaaacagcaaggatgaatctcaaatgcattctcctaagtgaacaagtgaacaaagccagactcaaaaggcttcacattgcatggctctatttacatgacattcaggaagaggcaaacgattggatcagacaaaaaccagtggttgccaagggctggggtgaaggaaggggcataaaggaactttaaaggatgagggacttgtcctatatcttgaatgtggttgtggttacacagctatgcatttgccaaaacttatagaaatatacacgaaaaggtggcttttattgtaatttatacctcagtaaacctcacttaaaataagcagtttttgattgaacataaaatctggttctgagcttcttggaaaccgactaaatgaagataatgtgttatgttacataactttcatctaggggaaaaatttctagtttctacgtgtgactgaaggttttcctgggataaaagttgaagacaatttctatcttggggcattgcataggagctgctaaatggataatattgggggcactgcatagaaacggcattggataatactctcagtagtaatttcatagagaataaaaaacagaattcgtatgatcttttttttacttgtataaatttaagcaatacaggtgcaattttgctacatagctatactgtgtagtggtgaagtctgggcttttagtgtatctatcgcctgaatcatgtatattgtatccatttagtattttctcatcactcaacctccttccacccttccacccatctcaatctccagtgtttatcataccacactctatgtccatgtgtacacatcatttagctcccacttataagtgagaacatgtgacatttgaccttctgtttttgaattatccacttaagataatggcctccagttccaaccacattgctgcaaaagacatgatttcattcttttctttatagctgaatagtatttcattgtggtatgtgtatacacacacacacacacacacacaccacgttttctttatccaatcatctgttgatggacacttgggttgattccatatctttgctattgtgaatagtgctgcaataaacaagtgagtgcagatatcttttttatataataatttatttccctttgggtagatacccagttgtggtattgctgaaccacatggtagttctatttctagttctttgagaaatctccatagtgttttccacagaagctgtactagtttacattcccactaataatgtgtaagtattcccttttctctgcatccttgccaacatgttattttttggtgttttaataataggcattctgactgctgtaagataatatctcattgtggttttaacttgcgattctctagtgattagtgatttgagcattttgttttttgtacgcttcttggccatttgtatactgtattagtctgttcttatgctgctaataaagacatacccaagattgggtaatttacaaagaaaaagtggtttaattgactcagttccatatggctggagaggcctcacaatcatggcagaaggcaaaggagaagcaaaggcacatattacatggaggcaggcaagagagtgtgtgcaggggaactcccctttataaaatcatcagatctcataggacttattcagtatcatgagaacagcatgggacaaacctgcccccatgattcaattacctcccaccgggtctctcccatgatatgtggggattattacaatttagggtgagatctgggtggagacacagagccaaaccatatcatataccttcttttgaaaaatgtctattcatgtcctttgcccacttttttggtggggttattttgctgttgttgttgaattgtttgagttccttctaaattctggacattatttccctgtaggatgcatagtttgcaaatattttcacccattctgcagattatctgttcactctattgattatttctcttgctgttcagaagcgttctagtttaattaagtcctgtttgtctatttttgttttggtgcttgtgcttttgatatcttagtcctgagttcttcacctagattaattccagaagcattttccctaggttttcttctagtgtttttgtagttacaggtcttatatgtaagtctttaatctgtcttgagttaacttttgtatttggtgagagatagaggtctagttccattcttctgcatatggcaattcaatttccccagtactgtctattgaaaaggatccatatgactatttcttgtataaatgttgaatgtgaatagagaacatcagatggcaaagctggtatgtggctttaccatctgtaaacagatggtggactgtccatctggtggtctcagagggtggcctcctaggtattcaccttgatgaagttagcagagctgaggccacacttttagacttgtgtgctcacaaacccttggatgcaaattcagagctggatagattcattctattgcaaaccaacatgttgatttattcatctgtgcctagaaatctaaccattctgtaaacttgatgacagcatcctctggccagcatgtttcttcctagttggaggcgtggtgtgtttgatggagcatcaacttagacacagaattagaatcttaactctgcatcttatgaactgggtgtgacattaggtaaattacttaactttccccaagcctcaaatttctcatctgaaatgtggaaataataacgtttctcttataaacttgctgtgaggagtaaataaaatagtgtttatgaattacttagcatagtccctgggcatgtaatttcttagtaagtactaatttttgttggttagatccagttacaggggaagcaaatttacagatatgtggttcatgagcaacagattttctggattattgtcttacacacagtaaccagactgatctttaaaaatcacaaacaagaaacaaatcaaattattcccctgcttaaactctctggaggtttcttattgcacttagaaactcattgtcatgatccctaggccaacacctgtggttcccacccttggctggtgtgcatagaatcttctggagaactttgaaaactactggtgcccaaattgatgcctagagattccgaagagtctggtccatgtggggactgggcactgtgacttttattagctctctagttgtttccagtatgatcttgccctgacccctccctcctgtctgtgtttcttattgggccttctctccttccctgctcctatgactgggacctcccttctaatctttgaatgtgctgagctcttccttcaggaccgaaagcctcttcattactgagccaggtgctaccaccccttctatgtcaagctcacattccatcttcgttatgactctggcctctggtcagaacttggggtgctctttcccttcaggaagttgggacttggagggctgggacttcaccatcagagtcttttgtgcctggttgtagttggaatctcgtgcattttcatgtagaggttacactgtttgcagggcccatctggtcttcacagtgaagagagaagtcttagctgttcaaaagtcatgttgcttgctattggagcccctgatatgtggcccagattatggtaaggcgagtgagtgaggcattgccttggtcataaattttaaggaggtcccgcaaactcagtagtcaagataaataatattttaatgcaatatttaaacaatcaaaattaatgcaaaaaatccatgatgaaaaaaaaatcagaattcaggtcaattccaggttgatttagtgaataaagagatatcaatagggactgctttatttttttatattttatttacttaattttttttttttaagatggaagtctcgctctgttgcccaggctggagtgcactggcacaatcttggctcactacaacctccacctcctgggttcaagtgattctcctgcctcagcctcccaagtagctgggattacaactgcctgccacaactcctgaataattttgtatttttaatagggacggggtttcaccatgttggccaggctggtcttgaactcctgagctcaagtaatccacccgccttggcctcccaaagtgctgggattacaggtgtaagccaacacgcccagtcacggactgttttatatttgtggttaagggggatttaagggataatttgagtctgttctgctttcttgggttgtgtttctcaaactggcttatggggatttccagcgatgtaaattttgtgatgaaaatattttatagtaaagcacacatggccatattgtggaaagaaatgccaaaattttatgaaactttaaaataaatcaagctcaactactggagaagctgaggtaggaggatcgcttgagcccgggagttggaggttacagtgagccatgcattcgaaagcagaacagaatcgaattatccctcgaatgcgctacagccacaatataaaacagtcattactgatatctctttattcactagatagatcctgaattgtctcgctctgtctcccaggctggagtgcagtgcgagaccttgtctctaaaacaaataaataaataaatacaaacaaaaacaagctcaagactttgaagaaatgataccccggagctttcagaccagagactcccgagttacacacattttcttctttctgccactaggtggaggcagtggagcaggttgagaatcactgtcataaagcttgtaattaaagaacatcagagtgccagacagtggagctgctataaagtgcagaataactactcctgtcctatacttggtcgcgtatgagcgggaagtgaatggaagggaggctcgaaacaatgggaagagccgtaagaatcaggtctgataaacttacataaacggccttgcacacaacttttctggctgaacctgcacttcccataagtcaaatgcaaatgttggaaggaatatcttgcgaggttctttctagcttgtacagcctgagctattttaaaggagaaaagctgacgagcaatcgtccttggaatttgcagtgcataaacttgaccagcaaagggcagcagtgcacacaccttttaaaaagtaactttccaaattttctactgccatgagagagttctgattctacaaataggagacagtgtttggaccacttaataacaaccaaccataaaagtaaattttctttttattaaaccttttaattttacatttgtaaacagaaaagaaatccttattttgttggctctgggacatcactttcttggttcaactccttcctcctgaccactgcttctaagtctcctgtgctgttttcttctcatctcttcgacctctacttgttgggttacctgccaggtcccagcctgccttcattgatttaactcattgctagtaacctcgccctgtttcccaaatttgcatctccacccggactatttcccgaactccagaatcacgcatattcatccacctgtccaagggatattgccaattagaggtctagcaggcatctcaaatgtctaatatgttcaactctaatccctgattcccgcctgccttccccatctcagaaaatgtccttccaaattctctagttgctcaggttaaacacttgcaaccaccttgatttcacgtttctcccacgcctcacatccaatatgttaacaaattctattttttctacctttgaaacatgaccagaatctgacacttttcaccacagttgccactgagcctcttgactattatcaagaaaggagatgtgttctgttttgtaaagattattaaaagatgttaaattgggactttttttgtatttgttttgtaaggtatctcaaaggccaagaataatataatggatattgtgttctctaatggaacaattcattttctctcctcctccactgcatttttggggatggtggaagtattggaggattttcagaataagaaacaattttattgctgttcaccagatgtcaggagggtatggtgtggtgggcctgggagtggactgtttaaccctagaacttagaaaccagtgtccctgtggagcacaaaccctaataggtcttggtgagtaacagaatagataaaagagagctcagtctggtcataaatcctttggccagttgccattcattgccatgagaaattccccaagaagacacccacctctttttcaggcaattctgtttactagattctggaggattcgttatcatcgaagaaccctgccttctagtcagatggtgcattagtcagaattctttttgcaagtaacataagtcagctgtaacacatacaagtagaaaaggaattagaaaaagaaaagtagttatactaatgtgaaagaaaaaataaacctcaggaccccaaaaatcactaagccaaaagggaaagtcaagctgggaattgcatcaggcaaacctgcctcccattttattcctaaataagatagctacaaagaaaaaaaagctacatacctccctcacaatttgcccacaaggtaattccttgtggacaaagaaaggacagagctcaaagtcatccctctgttcacttcagacaaatgcatatgcaatgcttcttctgccctactgtttcaataagccagactaaggcataaatgactatttctctacctgcctttcacatgtgaaaggctgatcagagactcaaaacaatgcaaccccagcaggaagcccccttccctgccttgagttgtcacacctttccagaccaaagcgatgcacatcttctacatatcgattgatgtttcttgtctccctaaaatgtataacaccaagctgtgccccgacccccttgggcacatatatcaggacctctggagactttatcatgggcttgtccttaatcttgggaaaataaactttctaaattaattgagatctgtctcatactttgagttcacactaggttgttcacaaagacacaaggaaggctatagatccaggatggggctatgcaggtggaaaatgtacctttgatcatgtcaccaaaccagtccagggatacgcccaaaacatgcttggcagcatgaggctgcagtgtgcactgatgacattagtgcttatggacttggtctcactgctagtgagagtcattttcttgattatttttctcaaatttgggtgaggtgaatgtgtagctccacaagatggtgtagagggggcaatgtgaagccatgtaaccttattgaacatctttttggagtgtccattttacttgaatggttcatggaaaaaaattatattaaaatttatacacacataaaaggcacaagttgtagtatttactacgagaagaaaacatgatttaagagataagcttcaaactgcacaaatagcagtaggggagacgaagatagttattcacttccctctgctgcttattgtgaaccatgagaagccccatcttaaagcgtctgaggaagtacatggacttataatagcaaatctatgcatatatcttattttagccttttctgctagactttgggttggagaagtgatgtgagaaggtgtaaagagcacaaaattaggagtcaaaaggcctggttttagcctcagctctgccacgaactaagtgacctgggttaagatatttctatctgtgccctctaagatatttccttacatcaaagaatgcaatagataatttctaaggttctttttggcttttagtctctaggtcattggaatggagacgttaggcgagcattcttctttggagctgtagaacattagtttgatcaccagaaggcacaggatcccatggtgatataggattataggaaatgaacaaaacacagtcttctctcatgcacttctctcacagtcttctctcacttctctctctcttttctgttttgtgtatttatattttccataatagggtaggttataccactgccccaaatctcatggcctagctccaacaaatgcttatatcttgctcatgctacaatcttcaccagggccagaaaggtgctctgctccatgcagccactcaaggatccaggcagacagaggctctaccatcttgtatttgcaccatttggagcacatggcctcttaagttgcttatacagataaaggatagactggaaaattccgtaagatctttttcctgcctcagcctgcaaaggatgtatgtatgcctatttctttggccatagcatttgtaaggagactgggacatataggtgagcaaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggttttttgctattataacttattgaattgatgaaatgacatacttttattaactgatttttctaatattaatttctagttccatgaggctttccactttggatggtaaaaagggagatagcatttctacttatatgcataaattaattctaggtagtgaattttatttatctgggaataatttttagatatggcaactctcattcattttgacaagaaaaatctaaagctcataaaccctgaatcctatatgcttactctcacaaaaatctctaatgtcctgctgggatttatccacagtttagattagacctggaatacatatggtcatgcaacaatgatcttagaacaggactttaacttggctttaggaactgaggctgagagtaatagaattgatttttttgtgtgtgtgtgaagctcctattataataatgagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgccttcggaaaatgttgctgagcaggcattgaagagtatcgataaaatttattgagaatttgtttattatgattaacagaggtaaaagccagtatattactgattaatataggtaaaaggcagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactcactggttgtttttgcataggcccctccaggccacgaccagctgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacagtgcttcagcctcgaacacaaacctcctccccatacgctgggccagtaggtctttgctgcagcagctgcttcctctgcacacagcccccaacatgcatgcttcctctgtgtgttggggaggtcactctcttgatttattcgttggagggtttgcagggcccaggattaaattaagagacttgacttttgctggatctctttttgtagaagattattaaagcaaaatgttgtaaagatcccttagagacattgtcaggagtttttgtgttgcaggaacctgcatgtttcacatggacacatcacatgaccgagccaaatagatttatctttactctctagaacagggtccactcagttttacgcacagatgggtcaattctttcctctatgtgcctccttgactctggaaagtttctacttggattcctaattctcttttttctttcttcatctgcaatccttcccaatattaaaccttgatccttcctattcatagcctcccacatagaaggtagtgtccctctgtagctttttccttccagagaccctgtttctttccatcatattaatactttcataggcaattttctaattctttattactctagaaatatgtgacagcatttctcattgccttttacaatagtttgccaactttcttcttatttatcatttttccatttttaattttcatggtatacagtagaaagattatatatacacacacacacacacacatatatatatacacatatgtatatatatttatggggtacctgagatgtttagatacaggcatgcaatgtgtaataatcacatcatggagaatggggtctccagccccttaagcatttatcctttgtgttacaaacaatccaattacactcttttagttatttaaaaatgtatagttaagttattattgactaaagtcaccctgttgtactagcaaatagtaggacttattcattctttctaagtattttttgtatggattaactatccccactttccccctactccccacccctgcccactactcttctcagcctctggtcgctatccttctagtctctatgttcataaattctattgttttcatttttagactcttcatatacatgagaataaatgatgtttgtcttcctgtacatggcttatttcactaaacgtaatgacgttcgttagttccatccaaattgttgcaaatgacaggacctcattctattttatggctgaatagtactccattgtgtttatgtactacattttctttttctgttcatctgttgatggacatttaggttgcttccagatcttagctattgcgaacagtgctgcaacaaatatgggagagcagatatctctttgatatactgatttcctttgttttgggtatatacccagcagtggagttgctgaatgatatcgtagctctatttttagctttttgaggaacctccaaactgttctccatagtgggtgtactaatttacattctcaccaacagtgtataagggttcctttttctccacattcttgccagcttttgttatcgcctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgcttcctttgctgtatagaagcttttaaacttaatgtgatcccatttgtccatttttgctttgattgcctgtgctagtggggtattactcacgaaatctttgcccagactgatgtcatggagagtttcccaaatgttttcttgtagtagtttcatagtttgaggtcttagatttgtctttaatccattttgatttgctttttctatatggtgagagattgaagtctagtttcattctcttgcatatggatagcgaatttccccagcattatttattgaagagattcttttccctagtgtaaattgatgacatctttgttgaaaatgaattgactgcaggtatgtggatttgtattgcagggttctctattctttccattggtctatgtgtctcttttttatgccagtgccaccctgttttggttactatagctctgagtataatttgaagtcaggtaatgcaattctttcagttttgttctttttgcttaagatagctttggctattgtgggtcctttgtggtttaatataaatttaagggttgttttttctatttctgtgagaaatgtcattggcgttttgatagggattgcattgaatctgtagattgctttgggtactatggaaattttaacaatgctgatttttccaatccttaagcatgaaatatctttccattttttggtgtcttcttcaatttctttcattggtattttatagttttcattataaagatctttcacttgtttggttaattcttatgaatttaagtatggttattgtaaatgggattatttttaattttttgtcagagtgttcactgttggcatatagaaatactgttgtttttttgtatgttgattttgtgtcctccaactttactgaactggtttatcagttctaagagttttttagtggagtccttaggtttttcaaaatatgagatcatataatcgcctaacaagaataatttgacttcttccattgaatttttgatctccttaatttctttcttttgtctgattgctctagctaggacttccagtaccatgctgaataagagtggtgaaagtgggcatccttgtcatgttccagatctctcaggaaaggctttcacttttcccccattcagtgtgtctgttatatatagtttttattatgttaagatatgtttcttctacatccagtttattaagtggtttttatttatttatttatttttgtttgtttgttttttacacatcacttcttttggccattcctagctccaagagggtctgtgttgatgttgttattgttttctaataaggaaaaagaggaaaactgaggttaggagacaagtagccacctgtgtacagggtcagacataaagtcaaatgatcactgatggagctctggtgataggcctctcttaaaaatcaccaaacttaatgcaaaatcctaaggactccatacctaaaaccccctaaaatgagatcagtgaaaatgagcagtgggcaaaattgggacccatgagaatgtatccagtaggatcatgatcagtcaagcaaatgggtttaacttggctttcctggtttattattatttatttcctggtttattattattatactttaagttctgggatacatgtgcagaacgtgcaggtttgttacataggtatacacatgccatggtggtttgctgcacccatcaactgatcatctacattaggtatttctcctaatgctatccctcccctagcccccgctctccccccgcaggccctgatgtgtgatgctcccctacctgtgtccatgtgttttcattgttcaactcctacttataagtgagaacatgcagtgtttggttttctgttcctgtgttagtttgctgagaatgatggtttccagcttcatccatgtccctgcaaaggacatgaactcatccctttttatggctgcatagtattccatggtatatatgtgccacattttctttatccagtctatcattgctgggcatttgggttggttctaagtctttgctattgtgaatggtgctgcaataaacatacgtgtgcatgtgttttatagtagaatgacttataattctttgggtatatacccagtaatgggattgctgggtgaaatggtatttcttgttctagatccttgaggaattgccacactgtcttctttggtacgtgtaaattgttgaactaatttacacgtaccaaaacagatatatagaccaatggaacagaacagcggcctcagaaataatgccacacatccacaaccatctgatatttgacaaacttgacaaaaacaagcaatgaagaaaggattccctatttaataaatggtgttgggaaaactggctagccatatgcagaaaactgaaactggatcccttccttacaccttatacaaaaattaactcaaggtagattgaagacttaaatgtttaagatctaaaaccataaaaaccctagaagaaaatgtaggcaataccattcaggacataggcatgagcaaagacttcttaagcatttttttgatagagtagcacagataagtatctgtctgttttttttttccaactgtatttccttctgctctatttttttctgtctctgcaacttcaaatatttgtaaattaattattgagaaaataataatagtaataataataattattattatttgagacagtgtctcactcagtcacctaggctggagtgcagtggtgcaatctcagttcactgcaacttctgactcatgggttcaagcaattctcctgcctcatcctcctgagtagctaggtctacaggtgtacaccaccaagcctggctaatttttgtatttttagtagagacagagttttaccatgttggccaggctggtctgaaactcctgacctcaagtgatccgcccaccttggcctcccaaagtgctaggattacaggcatgagccaccgcaccctgctgagataatgattttttaatcaaataactaagttttctttctgttctctatatattgatgtatgttgtatattgtcattgaaattttgattatactcaccatgggatatcttactttggaataggtggcatctcaaatacaatttatttcctttggcagaaggggattattttgttgtgaattcaaaccttcattaacttcagtgtaacataataccataagtgatgtttcctgttattaaatcacaaacagtattaggaatgagaggctgaagcaggagaatggcttgagctcacagatttgaggccagtttgagtgacatagtgagaccccttgtgaaaaaaaagagaaaattttaaatgcggtatatttaaaacacatatttctagacatttattactggtatatggaaatcatgtttattatctaatatcataaactctgacatgatcactatcatttctttagtttttaataaattttcagcatttgtgtatgtcatatgtatttattgattgacatagaccttaatgtcttataatataatacagaagtggacatgagcatattataatttaattaaaaaaatgaaagaatttccacttagaagaccaccatagctgttgctataaatgcagaaataaacacaaacttaactaaaaattcatgtgtatgatgacatcggagagctacagaagacacaaaggttagatgacctaaaattctagagaagaaatagacctctgtaggtgaggtaaatctgagctctcatttagttctttttttgtgtgtgtggtttccatggaatctatttaatcaaaactgcagaaggttctagaaaaacacatttttaaccaaggactgccgatgattctaagttttgagtaaaactgtggttgggggaaacaattttctgctttattgtgtgtccgagtacatacatgataaaagtaaaagccagggaatggaataaaacatagctttatataatatattagtagatacctaaatacaatatggtcttaaaaatgaagtcatatgtatatagttgtattcctaagtatgttagtcccccctcatccacaaatctcctttctgtggcttcagttacttatagtcaaccacagtctaaaacacatgagtactgtaaaagaagatattttgagagcgagagggaccaaccaaattcacataacttttcatattagatcttagtgatgcaaattagatcttactcatacaaatgagacattgaattaagtctttctctcagtctgacccttagaattgtcttttgtaagattttaaaatgcatcaagtaatacttacatatgtaacagctgacccctgagccatcactgacacagatggtaccaggactgctgtgcacagacaggctttcgactctgagtagtagacacaagtttgctgtatttgcagcctccacttgagggcttgggggttccctggcctggctacactgatagcacaactggctttgactctatccccaattccccttcctccctatcccctatgcaaatcccagtaattctccaggtgatatcctggggatttccttgggatattcttggtcttcatcctgccttagagaaaactgatcctcagaggcctcacctgatccagagttttaggtttatcctgacccagactctaattccagggttatcctcttgagttggaggaagaaatggtgatttttaaaagataatcatctataggatcagtagtcagaggcttcatgctgatgagctgtaggaaataagatcaaatggcagcaaaagggtggaatacggaagtttccaaaataataataaggtatagcccatttggttcactggaaattaaagagacccatggccttgaacaatgatgtatgtgtgagttacacacccttcaaagaaacatggtgttatctttgtgtgtctgcactgaatagcttggtcatataacggtaataagaatggcagcaaaatgcccagtcatcgcccaatgggctcatgaacaaagtgatcgcagtggcaggaatggagcttatgcatggcctcagtaaaatggactttcactccctacagctgatctggctgtggccacagctgagtgtccaatctgtcagatgcagagacctacactaattctctaatatggcaccattcccctgggtgacaagcagctacgtggtggcaggttgattacattagaccacttccatcatgtaagaaacagcatttcattcctactaaaatagatgcctactctggatatgaatttaccttccctgaacacagtgcttttgcctgaactatgatccataaacgtacagaaagccaatagtcctaagcaagtttatattctctggacacagtttttagctgctgcaatcaaacatgatttaattaacttaccatgggtaagtggcttctcttccttagctaacaaatgtgccactcaaaaacttagttttgcggcagcctcattttcattttttaattttgtgaataaattctgttatgaacagctattgtgttttaaatttttctaatttttacaaatcatgaataggtattggattttgacaaatgctttttctgcacgtaatgatataatcatatgaaatttctttcctctcaatctgtgtatctttaatttccattatttgtcttattatattggcagaacttgtagtactctgtggaaaaggaagtaagagggaacatcctttccacatcttagcaggaaagcttctaatttctcaccattaaatatggtgttacatgcagatttttgtagatggacttcatgacttgcatctacaagaggaagttctcttctattcttagtttactgagagttttttctttataattaatgagtatgggatttctttaaattctttttctgcgtttattgatatgattatgtatttcttcttaatctgttaatatgatggattacattaattggtttactaatattgaaccagccttgcagatgtggaataaatcccaattgcttatagtatataattctttttagatattgttgggttcgatttactaatattttattgaggaatattgcatctattttcatgagcaatattggtctgtagatttttttagtaatttcttttttttggtttggcattctgattatgccagtctcatagaaacaggaagtattctctcttgcttttctcttctggaatatattgtagagaagtggtataatttcttccttaaatattagatagaattcacccataaatccatctaggcctggtgttttctgttttgaaagcttattaattattgattctacttcttcaatagatacaggtcttttctgattttactatttcttcagtgtgagcttttgtagattgcatttttcaaaaagttggtttatttcatctaggttatcaagtaagtgggcacaaagttatctatagtattcttttactattttttttagcatacataaaatctataatgatgtcctctttttaattccttgatacttttccttgctctgaagtctggtctgtctgaaattattctggttttcttttgataagtgttagcatggtatatctttctccatccctttacttttaatctatatgtctttatatttacaatggatttcttgtagactacatatagttgggtgttttttataatgtggctgacaatctcttttaattggtgtaacaatccactgatgtctaaagtgattattagtacatttggattgatgaataatgtttgttatttcatatttggtgctctggttctttttgctcatttgtctccacactttttttctgtcttttgtgatttcaattgagcattttgtatgattccattttctttcttttcttagcatatcagtgatggtgatctttttttttgtttttgttttttactttttaagtagttgtactagggattgcaataaatgtacaattaatccaagtcaggttttatttacttttttatgctaatttttttattagaatgaaagctataaataaacacattacatagagaaaacttttaatatatattcctatgtgtagattatacaagtgatgtttgcatacattcttgttattaagaaactacaatgaagtatttagattaaaaagtaaaagtcactcttcatacaccactagtggtctttctactgttccagtgatttaataaaataatttttaattgtttttccaaaatattttattattaaataataatttttcatatttatggggtacctgtgatattttgatatatgtgtgtgtgataaacaaatcaaatgtgtaataaacaaatcaagatatttaagacatccatcacttcaaacattcataatttctatgtgttgagaatattcaaaatcttctcttttagctacttttaaatgtacaatgttattgatagctattgtcaccctatgatgctatcaaaaacttatgccttttctctaactgcatgtctgtacccatcaaccaacctctctttattccccccttcccagcttctggtaactattctactctctagctccataagatccactactttagctcttacatatgagtgagaacatgaaatatttgtctttctgtgtctggcttatttctaagtgcacttttaattaacattaaatgtttcatgggtagtgcaaatatgttatgataatagtagctattaatcaaaattctatgtattactgctgttatataattgtgtggcttaataaatcgaaattaaattgaagtataattaattttaactctccagcctgagtattaaaacaggaactactgatgcttaggcagtaagcactgtgagtaaatcattacaaaataaaagcatactcataaacattgtaacaaaacatatcaaggagttattataattctcccaagagtttagaatctccatgtttgaaaattgctgtaataatgcaaagcaattttccacagtattagaagtaaaaactaagtttaaatattgttatatttgatagaaaagaacattattctcatatgaagattcaaattatcaattattattgagaaaaacaatttaaaaattattttttccttgtaatggaggatccagtgatatgatagaatgcataagcagacattttgaattatatgaaagctgatcttgctattcatgttactattatattttcaaagtaataaaatatttttgagaaaattctcttcctgttttaagaagcagccctgcatttttattttgcactggggctcacaaattatgttgttggttctgttttccagtaatacatatcagataccagcaatgctgaagtttggaaactttctagaatgctttttgtttcattaggaagagtcctccacctccatgattccctttgccttctagaagaataaaatgggaaaaacagaattttattattaaaaaaaaaaacccagaagagtaacatcactttccactcaaactgactacactaatctaatttctcattctttatctcttttacactaaggtatacctgtaattttcagagttccattttcaaagactgcttatagtttttaaaaatgtgcatttatggtatagaaagaaaatcattttacgactaccaggttccactgaaaagtaattaatatactgtagtcaaaataaaataaaaattttaatacatgaaaacaactaccgaaatgttatgaaattatagtttagtagaactaacaagtgcattaatgcaaaagaaaagtagggctcagtaatcagggaaccaagtgtgcattgtaaaagtgcagcctctctaacactgggtttcatcacaagtaacagaacaggatgcctgatgcagggaaaaaagaaaggcaattgttggcaatgtcaggaatattgccatggcgtctaccactggtgggttactgagcatcagaaccacagaagaggtaacactgaagcctgcagaataatgagtcttgttgcagaaatgcaaagaaaaagaaagatgataaatgcacacccaggaggttacgttaattttaaccttctgagtgtgcacagctgtgaagataaaactatgcacagctcatgggttaggtttcacacagtctgccatttaaacactccctatgtcaccatcatgtaccatataatttgcatatttgtcctttatataaccctataatatgtttgtggccataaaatctgtgctgtcaaactgattaggaactgactaccacctgcaggtcagggccaaggttatggggtcccaggttcacctcctcagcttcctcctcctttggatctctggtaagagaaacacttcctctcctctgtgccaccaagtcccctgcatatccacaaaaataatatattttcataaggaattgattttcctcattctctgcaaatatgatgcatttgatttatgttttttactttgctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctcacagtgatacaccctgttacaaaaacctccaagttctctcagtgggattgcctcagctgctgctgaaaatgttcagaatgtggaactgggtggccctgtggtgtttataaggcttctccatgcccatgcaactcacttcctttttctttttgtttctgtagtttctgctgcccccatgctgtgcctgacacacttgatatggcaaaaaccaggacagcctttctcacgttgtccagctgtgccaacaatttcacttccaagcagaggtaaattctcatggccaactccctgtcttttgccacactcatcatttccacctccaagaaaaacaaaaccaaaaaccaaaatgcatctagcttagattccaaatagtagcattaaaggaaattgtccctccctataagcattctcaccctcatccacacagtcatcgtgactcttccctaacccactgagtgctcaccagtcctcttcagtcctccctccagtgatggggaaaagcgagtgatagttatgagagcaacatgtaacctgggtgcagactcttactagtcaggtttgcctcagatttcaagtatttatctttcttttattttccattttttttcttaattatatggatcagtaagatgtctcatttcttttttttaagttacttgttcttttaacacaattcaattctataattccaaatttaaagagataccctgtatgtctttggcatgtgttatatctggacaagttttgggttatccccttcatgccactgctcaaatcttacctgaaaccccacatatttttccaaaaacctgaaaactgtgtagcggttgaggaaattaaatttggcaaatcacaatacttgaggaaacatgtatctttttatcttcactctctaatgttcaggtgatgctgtttaattgagcatttgctatttagaatcacccctctgaaacttgtgggaaaacagcaccagcaaggcagtcttcatgttttgacctcattattcctggattatgctagccttcttgctattgttctactacagccactacctgaagaaacctcatgtaggattgtttcctaatgaaatattaagatttatctgcaattatccctaactctgcaaacttaactgacttctcaggttagtatttaatagccatcaaataaggagtggctgaaataatattaccaaggaaggaaataattggatcatagaaatgagggctttgtggttattgcatggtgaagaccaacaaaggccattgcaaccagtaataatatgcacaatgatgagctcgtagttaagagcaatttctgtcttagttttactgtcactgaactgggctggaaccctggagggcagggtagatgaatgataatcaaaaacatgatttcatatgttaagttctttggaaggctcaatttcggagatttctcccactttctataagagcagacatcaaagaatctgattctggaatctcgttttttctcttacagctctctttttttctactctaatctcttttccgcttccaaggacatacattgataaatatggtcaacagaatattaaggtgatgtcaatattagtgactaccctataagagggaacagaaacattcgtgtttgtaagcttttagtcctcacttaagcttctttcttgagtaatgtaatcgctccccttaatgtctggagcagacattagtaagaataataaatagtatgtttagtctcaaagatggtgaatacagaaagtggtcagaatgtgaacaacactattaagtatttagctaaaaataaaactattgagttttgtaaattcttatcaagtcttctctaagattgaagctccaggttttagtgaaaatcctgtccaggaaatattacattataatccctttctctctgttcccatctaccttaggctcatagtgacatgaaagcaaatttccatcctctgggaatatataaacccggattatttctttttatatagatgctctatcccttgcctgtgtgctattttcttactgagtcactaccttgcaccatgtacacaacccccagtggtttacgataggatgaacctattgaagcagctagcagagaaaaggttatttatgtgggtaactgtgtatgcttgttggacattccctgggtctctcacactgttaccacagcagcattataaaaacatcatctatctatctctctatctatcaattgatctatctgtcaatctatctattgtctatctccataaacacacaaacatactcacatttgtgtgtgtgtgtgtgtgtgtgtgtgtgtgtatgtatacagaagaaatgataaaagttatatatgtcttatgtcccaaactttagaaaggatatgtaacatgttagcaatctttgaacacacttgctggaatatagagtaaaatactttgttgctggtatatcaaactgtagtagataatccttctgatttccaaacagggtatacaaatgcacctttccaccagcaatgtatgagggtttctattgttctacatgtccaccaatacttggtattgtaaaactttttaatttaagcctttcttctacatgtgtagtagtatcactccataattacgatctgtgtttgtgggattatatatggattatatatgcttgtagggcatttgaccatcctctgggttaaaatttctgtcaaattctgcccattttactaatgcattttctgatttagttgaacagatatgtatgaaaatatatatataacatatgcgtgatatatatcagcgtgtatctgcctatcatccatccatctatctatccatcaatctgaatgtttgtgctctgccaaaattcatatgttgaaatcttaatctcaatatgttgatcaagattgagccttggcaggtaattaggctgttagggtaaagccctcatgaatggaattaatgtctttataagaagaagtgaagagaccagagggctagctagctctctgctcttagccacatgaggatgcaaggagaaggtcctctacaaacctggagtcgggcttcactatacaccagattggctggcaccttgatcttgaacttctcagcttccagaattgaaaaagtttctgctgtttaaccctgtccatcccccagtttatggtagtctgatatagcagcctgaactaacatctgtatctatatttatacaattatagatatagatagaaccagtattttttcgcatttgtctctgtctctggtttacctttttactcacttaagtctgtaaatggaatcattttcttaatttgtttttcagattgtttattgttattgtagaaatgcaacttttttattttctttcctgaaactatatttaatttatttattagttctaatattttttgataagttttttaaaaaaatttattttgttttaagttccaggatatatgtatggatgtacaggatgtgcaggtttgctacataggtaaacgtgtgccacggtggtttgctgcacctatcaacccatcacctaggtattaagccttatgtacataagctatttatcatgatgctcttcccctatcccccagtgtgtgttgtccctccctgtgtccatgcattctcattgtttagctcccacttgtaagtgaggacatgagatgtttggttttctgttcctgtgttagtttgctgaagacaatggcttccagctccatccatttccatgcaaaggacatgatctcattactttttatggctgtataatattccatcgtatatgtaccacgttttctttatccaatctatcattgatgggcatttgggtggattccatgtctttgctattatgaatagtgctgcaatgaatgtacataagcatgtatctttgtaatatgatgatttacattcctttgggtatatacccagtaattggattgctgggccaaatggtatttctggttctaggtctttgaggaattgccacactgtcttccacaatggtggaactaatttatattccaacagtttaaaagtgtttctatttctccacagcgtcaccagtgtctgctgtttcttgactttttaataattgccattctgactatcatgagatggtatctcactggggttttgatttgcatttatctaatgatcagtgatgttgggcttttcttcatatattttttggccacatatattttgagaagtgtctgttcctgtcatttgtccacttttaatggagttgtttgtttttttcttgtaaatttgtttaaattcctggtagattctggatattagacctttgtcagatggatagagtgcaaacattttctcccattctgtagttgtctgttcagtctgatgatagtttcttttgctgtacagaagctctttagtttaattaagtcacatttgtcaatttttgcttttgtttcaattgctttcgatgtttttgtcatgaaatatttttatctgggtatgctgaagaatagttttcctaaaagttatatattaataaacaaagagttagtgagagcactagaatcagagaatatatgtaagagtttgttcaaagcagggtcttaaattttagtctcattgcaaatttggattctattcctcttgaatggactactgaagagatataaagaccatgaggaagcacgaaaatatctgctttgctgcctcaaggatgtttaattgccccattgattctcttgggaaagaattctcccattgttgctcactgattctcaaagattagaagtaaaaataacttaggggatttgtgactaaagttcccatgcctagagatactgacctcctacgtggtgttgagtttaccttaattcttgaaggatgcttaactttgaagggaactctagctatatggctactttttcttatcattttaaggaaattttatggtctctgcttttcctcatttatgtttagaggttagctattaatcttattcttgtttcttcaaaatgagagaattttttctgattaagatttttttgtttgatcagtagatagtaaagtgtgacattatttatacaacgtaacactacacaacaaaaaagattaataaattgcaacaacttgaatttttacagtaaaattaaaatgacacatatctattacctaaaacacatctgagaagctaatttatagaaatagaagtatgcatgtgtaaagatataggtaaaattgtattaacaaatccattgattatattagcaaaacctgaacataatttaattgcccttcagtagaaatgtttgaataaagtataggttttctacacaatccaaaatgtgatgataaagaataggttatatttttcatctcttgatctggagataatctctttagaaatgttaaacataaattcccaaaaatgttaatttatgagccaatatttgaaaacatagaagcagaattatgaaaagtagtaatttgtcttttctatctttacaaatatggaatcattttacatcttgtggggttacaatgaagaaaaaaagcagttatgacaatgggaaaaatgtatgcgtaacatacagcaatgttcacagagatgaatgaagttatagtgacaaatgaaaaatgtaaaaggcaatttgatttatattgaatatatatatgtcaggaatatggaatgagaggagacaggtaaacacaataaaaactctgaccaatgcctgaaataaggatattacagaaataaaacaatgctatttaaacatctaaaaacagcataataatcaccagaattaaaaaagatcctgtagatgtgtgttcattcatagaaagatggaagtccctacattattattaatattttcaccatcagagaaatagggtgctactcagaaaaatattttttaaacaattgacctaaatcatatcaagtaatgagatatttcttgagtccaggcatgatcatgtaaatgcatgttggttaaatccttggacttgtaatgcacattacaactttcagaactcctctctgtttagcatttataggagaccttctgactacatcaaacttcatctaatcacattttacctgcactgagaacttttggtgggaagtgagatggaacgccatagtgtcattgcatattcagaccccaagagggagctgagagatcatgccttgaggaagtgattctgaaagagtccccacagtggaggattccagagctctgtgtgataacattgcctatccactgacccacgccctccccaaatgtgcaaagaaagtccagctgccagaagcccttatcagtgtgcagattccccataatcaacactcctttgcatccaccatatctgtaggggaagtgcagttccaggctcagctcctcaggtgtcttctacccaggtgaaagtccaaggtagatcagtcacaaaatcagtgcaattttaaaattgctttattaaagtacagtgtcaaaccatgaaaagcacctattttaagtgtgcaaatcactgacttatggtaaatttgcaaagttgcagataaccacagtttaatcttacaacattttaatcatcccctgaaggatcccttatgcagaccggcagctatttttatttccactcccagtctcaggcatgtattaatcgactttccctctattgattgcttgatatgaacattctatataaatggaataatgcatgcatggtcgtttctatctggtttctttccattaaacgaagtttaggttcatccctgttttagcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattccccttaaaaactgacacaagacaaggatgtcatctctcaccactccttttcaactgagtattggaagttctggccagggcaatcaggcaagaaaaagaaataaagtgcattcaaataggaagaaaggaagtcaaactatccctgtttgcagatgacatgatcctatatcttgaaaaccccatcatttcagccccaaagctttttaagctggataagcaactacggcaaagtctcaggatacaaaattaatgtgcaaaaatcactagcattcctatacaccattcatacattcctatacaccattcatacattcatacagcattcctatacaccaacaacagttattccgagagccaaatcacgaactcccattcacaattggcacagaaagaataaaatacctagaaatacagctgacaagggaagtgaaagatctctacaaggagaactacaaaccactactcaaagaaatcagaaacaacacagacaaatggaaaaacattccatattcactgataggagtaatcagtaacattaaatggtggctatactgtccaaagcaatttatagattcaatgctattcccattaaagtaccactgacattcttcataaaactagaaaaaaacaattttaaagttcatacggaacaacaacaacaaaaaagtcctgaataaccaaggcaatcgtaagcaaaaagaacaaagctggaggcatcacactacccaatttcaaattatgctacagggctacagttatcaaaaccacatggtactggtacaagaacagacacatagaccaatggaatagaatagagagcccagaaatatgtcctcacacctataaccatctgatctgtaataaagttaacaaaaacaaaaaatggggaaaggacttcctattcaataaatggtgctgggataactggctagccatgtgcagaagattgaaactggacgcctttccttaagccagatacaaaaatcaactcaagatggataaagtatttaaatttaaaacccaaaactataaaaaccctgaaagacaacctaggcaataccattcaggacacaggcacaggcaaagatttcatgacgaagatgccaaaagcaattgcaaccaaagcaaaaattgacaaatgggatctaattaaactaaagagcttctgcacaccaaaagaacctatcaacagaatgaatagatccctacagaatgagagaaaaatttttcaagctatgcatctgacaaaggtctaatatgcagcatctataaggaacttaaacaaatttacaagaaaacaatcaaccccattaaaaagtgggcaaaggatgtgaacagacacttctcaaaagaagacatacaagcagtcaatagtcatatgaaaaaaagctcaacatcactgatcattagagaaatgcaaatgaaaaccacaatgagataccatcgcacactagtcagaatggctgttatcaaaaagacaaaaaataacagatgctgatgaggttgtggagaaaaaggaatgcttatacaccattgatgggagtgtgaattagttcaaccattgtagaagagagtgtggtggttcctcaaagacttaaagtcagaaatacaatttgacccagcaatcccattactgggtatatactcaaaggaatgtaaatcattctattctaaaggctcatgtatgagtactttcattgcagcaccattcgcaatagcaaagacattgaatcaacccaaatgcccatcaatgatagactggataaagaaaatgtggtacatacacaccataggatactatgcaagcataaaaatggacgagatcatgtcctttgcagggacatggatggagctggaggccattatcttctgcaaactaacacaggaacagaaaaacaaacactgcatgttctcacttataaatgagagttaatgatgagaacacatggacacacaagggggaaaaacacacacttgggcctataggagggtggagggtgggagaagggagagaatcaggaaagataactaatggatactaggcttaatacctgggtgatgaaataatctgtacatcaaacccccatgacacatgtatacctatgtaacaaacctgaacatcctgcatatgcacccttgaacttaaaagttaaaaaataaaataagatctctgatctattttgatctagtgtgcatggcaagagatcagggcctaaattcgtcttttcacctatagataccaattgaaaatctatccttcctcccatttaatttcctaggcattattttaaaaaataacttaccaaaaatgtaaaggtttatttctagattctcaattccatcctactgatctataagttcatttttgtgccagcaccatcttgtcctggaaactgtagtttatagttgttctctgctttatagtataggcgatccttggacaacactgatataagctgtgcaggttcactcatacatggattttctgccacatctgaaataacaagaccaatctctcctctccctcctcctcagcctactcaatgtgaatacgataaggatgaagacatttataatgatccattttcacttaatgactagtaaacatatgttctcttctttataattttcttaaaaacattttcttttctctacattacttgattgtaaaatacagtatataatacatataacagtcaaaatatgagctaatcagctgtttatacaattggtaaggcctccagtctacaacaggctatcagtagttagatttttggggattcaaacattatacatacattttctattgtgcacggcgtctgtgcccttaactcccacattgttagagggtcaactgtacattttgaaactggaaattttatgccctccaacttcaattttcttgaaaaattgttttggttatttgaagtcttctgaattttcatataaattttagaatcagttcaccaaattctatagcctactgggattttgactcaaattgtgttgaatctgtagatcacactggagagaattatcatcttaataatactgaatcttccagtccatgaacatgaaatgtctcttcacttatttggatcttctttaatgtctctcagtaatgttttatagttttcagcatatctcttacttttttgttaaatatattcagaagtattttcttcttatcaatgtttgttcattgtctttatgctttattttcaagttagtgatccacagtagtcaatcttatttgtgtattctgtatttgtgaatttgcctgcctgctaaaatttaatacaatcccaaagtcaatacatagagtgcttttattctcatttgtggacatgcacagagtggcaaaaaaattgagccactgaacactcatgttcccaactgaggtttaacaaagccacactcttccatcttgtttcacttctcatactgtaaacaagtgtccttttgctcaattttgctctttatgttggtaattttgtggttataaatgttccccaaatataataatgctgaattgctgtttaatgttcctaagcacaagtctgccatgtgtcttacgaagaaaatatgtgtgttagataagctttgttcaggcacaagtcatagtgcttttggccatgagttcaatgttaataaatcgtgtgtgtatgtgtgtgtgtgtatgtgtgtgtgtataggaaaatgccttgttttattgcacttcactttgttgctctttgaagatactgttttttacaaattgaaggtttgtaacagccttgggttaagcaggtctatcatcaccattttcccaaaagaatatgttcactttgtgtctctgtatcacgttttgctaattttcacaatattttaaatttttcattattatatctgttagggtgatctgtatttagtgatctttgatgttactattataattgctttggggaaccacaaaacacacaaaccacacttactcgataaatgtatgtgtggtgactgctccagtaactggccgttccttgttttcctcttgtcgggcctccctatttcctgagacacgataatatgaagattaggctaattaagaactttataatgatctgtaagtgttaaagtgaaagaaagtcacatgtctctcactatcaatcaaaagctaggaatgattaggcttagtgagcaaagcatgtcaaaagcttagatagaccaaaagctagacctctcgccccagttagccaagttgtgaatgcgaagaaaaagttcttgaagaaagttaacagtgctactccagtgaacacatcacaaatgtctaaaaagcaacatagccttattgctgatatggagacagttttagtgatctggatagaagctcaaaccagccacaacattcccttaatccaaagcctaatccagaggaaggcccaaactcatagaatttatgaaggctgaaagagatgaggaagctgcggaagaaaactttgaagcagcagaagttggttcatgatgtttaaagaaaaaaagccatctccatgacatacaagtggaaggtgaagcagcaaagtgctgatggagaacctgcagcaagttatctagaagatctagctagaagtattaatgaaagtggctacacttaacaacagattttcaatgtagatgaaacagtcttatgttggaagatgatgccatctaagactttcatagctagagaggttcctggcttaaaagtttccaaggacaggcagactctgttattaagataatgcagctgatgacctatgttaagtcgaagccaatgctcatttaccattctgaaaatcctagggcccttaagaattatactaagtctatttttcctgtgctgtatacatggaaccacaaaacctagatgacagcacatccgtttagagcatggtttaccaaatatttgttgagacctactgctcagtaaaaaaagatttctttcaaatattactgctcattgatttacaatgcacctagtcactgaagggctctgaaggagatacacaaggagatgaatgttgttttcatgcctgctaacacaacattaattcttcagctcatgcatcaaagagtaattttgacttccaagctttattgcttaaaaaatacatttcataaggctagaactgctgtagatagtgattcctctgatagatctgggcgaagtaaattaaaaaccttctggaaaggagtcactattttagatgccattaagaaaatttgtgattcatgggagctggccaaaagatcagtattaacagaagtttgaaaaaagttgattccaaccctcatggatgatttcgaggggttcaagacttcagtggagtaagtaaatgaagatgtgtaaaattaaaagagaactagaattagaagtataactatgtaacaaacctgcatgttctgcacatgtgtcccatttttaagaagaaataaagaaaaagaaaagaagcggagcttgaagatgtaactgaattgctgcaatatgacagtaaaacattaatggatgaggagttacttcatacggatgagcaaataaaatagtttcttgagatggaatctactgctgtgaagatgctgtgagcaaggttacaatgacaacaaaggatttataatagtataaaaaaatttagttgataaagcagcagtagggctcgaggattgactccaattttgaaggaagtactactatgggtaaagtgctatcaaaaagtatgtcatgctacagagaaacctttaattaaaggaagattcaatcaatgcggaaaactttattgctgtcttattttaagaaattgccacaatctccccaactatcaacaaccaccaccctaatcagccagtagccaacagcattgagataaaattctcaaccagcaaaaagattactcactgaaggctcagatgattattaccattttttagtaatgaagtattttaaatgatgtacattgtttttaaaacgtaatgctattgcacacttaatagactacagtatagtataaacataacttttatatatatgcagaaacccaaaagtttgtgtgattcactttattgtgatatttgctttattgcagtggtctggaaccaaatctacaggtatgcctatatgtatatgcctatatttaagactttatgagatatatataatctgtttaagatactcatacaaaaagttacctattgatcagttaatgaaaatgtgaccataggctcataggaacataaaccagtactaccactaggaccaatggttcaatatttgttaattcagcgtttgtgactttacagatatctgttgaaacataacaaaatgtaactgtacatggagataaaatttatttctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgcataatcatttctatatgctactggattctatttagttatatcttttgataattttttcacatgcattagtaggggatattggtctatggttttctttccttggaatgtctttgcttggctttggtattggggtaacactggcttcatagaatgagttgggaagtattcttttctcctatgtatactgaaagaatttaatgaagattggtaatatttattctttaaattcttgatagaactcaccagtgacgccatgtagtctcagtttttctttattggaaactttttaatttcttcacttgttatggttctattcatattttctatttgtttttgaattagttttgggttatctcatctaaattgcctaatttaatgacttattattgttcatcatattctcttacagtatttttaaagtttctgtaggataggcagttgtaccccttatttcaatcctgattttaataatcttggccttctctttttttcttcaagagtcataaagatttttaattttgccaatctttccagaaacacaacttttgctttcaatgattttcgtcttttacttcattgatttatactctatttttaaaattattttcttccttctgcttgctgtgaatctcgctggttcttctttttctagtctcttaaaatagaaactacccaattggtttttagatattctttctttctttactatacaggtaattacaggccaatatttataaaattatttatttatttcaaatcttccactctatagatgaaaccttcaccacttcgtcactcaggaagcaacaggagaaacatgagaagctgggatgaaaacaccattttgaggaatctgtttgtctgatgctggtcagaacctattaccagaggaagcttccttatttaatccccttaggacaggggccatttgagagaaagagaataaaaacaaacaaaacacttaggcaatatgacagttttagtggacaaccctaggttggccccatgatacagaaccactggtgttcctaactgtgtaattccctcttcttgagtctgggcagaatttttgacttccttctagcatacacaatattgcaaaggtgaaagtattttgcagatgcagtagtcccaaatcagttgggtttgagttaatcataagggagattattgtgagtggatctgacttaagcaggtcaaagccattaaaagaggaactgagctctccttgttaccaagaaattatcctagctggtttgattattagtagcccatgtggcaggaaacttaagatgttctctaggagcttagggtgatctccagccaacagccagcaaaaagccaggaccctcagccttagagttactatgaaaacaattctgtcaacaacttgaatgatcatggaagcagactctttaagtccctggatgagaatgcagcctggtcaacaccttgactgcagcctgtgagaccttgaagagaggacccagataaactctgcccaggctcccgactcatagaaactgcatgtgaattataaacgtgtattattttaagccactaagtgtgtgataatttgcatgggccaacagccaactaataataaaattttatatgtagtgagatagggttacaagggttacaaatttagaaaccaatgtaaatcttattagactgaaatgctgcaaaagcctattttgccagagtttctctgcttgctttgtggaggatgcagaagactgacggaggccaaggtagggatggaggggcacataatcactaatctttccatgattgtgactatgcacacctgcatttctggagtccactctgcctgtagtgttagagcaattagaaaagcaaaaagagaagatgagaaaaaaaaccttaacaatggacatggaaaatatcatagaaaaaggacatgacctgtaatcccagcactttgggaggccaaggcaggtggatcatgaggtcaggagttcgtgaccaggctggccaacatggtgaaaccccatctctactaaaaatacagaaattagctgggcgtggtggcaggcacctgtaatcccagctacttgagacattgaggcaggagaatcacttcaacctgggaggtggagactgccgtgagccaagattgtgccattgccctccagcctgggtgacagagtgagactctgtttaaaaaaaaaaaaaaagaaaagaaaaaggacatgaacactgcatgaagagtaaaggacaatttattaaaactagagctgagaatctaacttttgggaaagtcaccgagatagagacatctaaattaaataagcagagataactacctcacaagtcttaggtttctaaataactagaaaagccttttcatgtgggttcagcaaataaaagtggagaaaagtcaaaattcaggtgagaaggtcacctatatctgaaagatatagagctaataattttgactattcagagcattttttaaaatgactacaaagttttcttaatgtttaaaattcttctattggtaagggtctttgacataaaaaatatacattgagaagtagaaaacttctgagaggtcctgatacagtaaagaaattattaaattataaaactggctgtgacacacatgcatgcacacacacacacacacatcaatttaaggattttctctttgataatttgacccctttgttcaaacaagcctatgacagcaggctgatggacctgcataaaaagccacatctgagggatttgagcctcagggagcagctgcctggggaggtttttgtttagacctaaagcactgtgggaggaaaattcttactctgcagacagtaataatttgcagtatcattagcttccacaggattaattgtgagggtgaaatcggtcccagacccactgccgctgaacctggctgggaccccagtgtctttattggatgcttggtaaatcaggagtttaggaggttgtcctggtttctgctgataccagtgaattaagtttattcccaagaaactgacactctcactggctctgcaggtgatggtggccctctgtcctggagacacggccaaggaggctggagactgggtcagcacaatgtccccattgcagcctgaaatgataaagacagataaattatatcagatatactgagactgtccccatgtaggccatgcattggtgacacttgtaaccacagtcatatgcaacatcttgagtaaccagaaaacaaaagataactggggaacttacaacctacaatgagtgccctaaatccaacaaccaagaatccagagacacaaaaaacaatgatggccacatgagtttgcccgatgtttccctataccccctcacttggagcccagagcaggaggatccacagcaaaggagccccggaccctatctctgagagctgaactagaggctgctcctcaggggccctgacaagctgtctttaaggatgctctgagaagcttggaccgttgtctaatggcccaacatgcaaatcagctcagaaaagtttgagttgatgctcaaaggggacacctgctcttatttcacccagtgggagttggggctaacaaaacatttcctagggtagctcaagcatgtcccaagggatttggtgaccttttctattggatctttgcctgccagtctacttgagatgccatgtggaggagtgtactggggctgccctgccatttggatataagttatttcagaaatacttttgatttttcaaaattcatattttatatcattatcaataataatgcattttaagttatcattgtcagaaagagaaagcaagttgggtgggttttatgaaactggttcatatgggaaggagaagtttgttccactgagtaagtggtatttaaaacaagtctataaatgttatcatgatctggaaaggatgaagggggtgagcatgaaaccttgatgaagactggtaacctaaactaatcaaggaacttgcctcattgtggataaggcagggtctctccatctgcttagtcctgaaaccaatgctgtatccaccagaggccctcagaggcagaagagtcattgtagtggatcctattcagagtggagaataaccatcccccaactcccactggttccatctgccttgccactggaagctggggctaaggaagtccatcttctcctacagcaagatatggtgtccacaccagtcagctggcactctcacccatccataggtgaaggttttcccccaacaaaaccaacttaaaatgtctggaagaagggactgcatcttcaaatgtgcagacaccaacacaaggctacaaggaacatgaaaagtcagggaacatgatgccaaccatcacttctctatgagctccactccaggactctattctgttacttgtgatggagttcagggccagagaggtcccactatactgcttccaactgtgcgcttgggtccctgattactcagttatatttttcattgatgttaacatgcatattagctctagttaactaaaagttttcttttatcactctgggaattgtttttatgcttttaaatttttattttatttgatttcaactaaaataaactagtggcttcccaaaggatctaggtagaactaaaataatggtctttctacaccttaaatctacatttttataaacagctgaaaatgaacagctgagaattacagctacaccttagggcaaaggagatgaagagcgggaacttagattagtgtggtgagtttgagtggaaagtactataccctcttgtttttcctaaatgattaaattctgcttacctagctctattcccctagaagaaagcaggaataatggaatttgagtattccttgaaaaaacaaagaacattttcaagaaatttaagaagttttcaaactttaacctttcagatgtctagtagatatctctggaaaacagggcaagcatcaatttgtggattgagaagaaagataaaatatttcagaggagccaatatgccatgagaaaagtcctgaaaaactccccctgaacccttggaacttttgtgccatgattagggttgggacaatccctgagctttgccccctcctacaactctgggtggaggaggacagaagtagaggtgggaagtaaaaggggtgaaatttgcatttttttattaggccacctagatgaccgatcattaagaaggctctagaaaatagagacaaacttgaccactttaagttgttcactgtcccatcctctgtcttctactctttctccagcaaccaagtgataactactacacacaacctgcaaggatacagtcctcagactcagatctggggtggaggtagggaaggtaataataaaatgcacccacatgtgtttggagcaatcaagaaatattgaactataccatattttggcaaataaaagacttgggtaaagcaaccccatcaaggataagtaatttgaaatgaaataatactgaaaattacaaatataccatgggagagggctatatgactgacaaaaatacatagcaagtaaataataaattagataactcttctgaaaatgatgtactctagtaaaacaaaagtattttctgcagcaaatgattgtaaatttagaagacacaccaaaaaaaaaaaaaaaaagaaaaacacttaaatttattttcaaggatgagatagcaagaaaataataggtaaaataaatgtgtctggttacaggtacaggattaaaaaagtaaagcagaactagtaattttaacatagaaaaaatgtaataaggcaaagaaataaatggagtcaaagacacataaggtaagcttagtaaagggataaagttcagaaaaaaaggcaaaaaaaattacagataattatagaaaggatagaaaataggcacccaatatacatggataattgatgtgttttaattatggaatttaataaaatggcatatgaaataaaatgtaataacataatgaccagaatgtcaatatgtttaagtgaagatatgttaaaacaccccaccataacatatatgtgaattacatatttattaaatacagaaatattaaaagataaatctataacaaagaatttatatgaatatatatctgactttgtatttaaagagactatttataagccagaagaaaaaggaattctaaaagaaacaaaaaaatataaaaagaaagcaacagaagcctaatataaagtttctaagtagaagttttaaatcaatgtcaaacacaaaattatacactgaagaaaatcaatacatgtaaaaataaaagtaaactataaaaatcaaagacatctcacaaaatgatgaagaaagcaaatttaaattagaaaaataatccataaaatgaaaaattaataaattggacctcatctaaattgaagtttttgatctgaaaaaaaatctctattaaagggatgtaataaattgaaagtggacttgtgtaatttagcaaatgaactcttgagcaattatctcagagaaataaaacattattatacagaaacttgtacacaaatgttcacagaagctttatttatagtagctaaatcaaggaaattacccaaatgtctttcagtaagtaaacagttaaataaactggggtaatccgtattatagaatacattcagaaataaaaagcaataaacaattgatatacccaactttgatgagcctgaagggtattacgccagtgaaataagccaatctcgaaatggtacttattgcatgatgtcttttatgtggtgtttgccaagggttaaggatggggtagagaaggtgagtgcggctataaaagggtaacaccaggagtcgtgtggtgatgatttagctgaatttcttgattacagtggtggttatagaaggtcacataaatgattcattcacatcgagctacacacacataaacacaatcacataaacaaacaaaaattgtgtgcgtgcgtaacttgtgaaaactgaataagttctatggatgacaccaatgttaatttcctgtctttggtattgtactatagtttgaaagatgtcaacactggaggaagttgccaagatgtatgagacttctgtatatttctttgcaacttcctgtgaacctataactatgttatagttaaaaaataaaaagtaaaaaaaatcttaagctttattacttgaaaaccttgaaaaaaatgaattgccctttttctatcaaatgattggcaaaaaaacttaaagccttatgcctccctctgctggtgggaatggagagggattgaaaagccatactttggtggttgcaatgtggatttctactgtttcctaagtaatctctgctcactattggagtgaaatttaaaatacgtacacttgttggcccaaacttactactaagaaaattgcctatagaactaataactccgtgttgtctaaggaaacatctgaatgcctatcagtaagagatggctaaatatattgtgctattttcatattatgaaaaattatggctgcctctgcctctgcccctctgcccctctgcccctctgcctctctgcctctgcctctctgcctctgcctctctgcctctctgcctctctgcctctctgcctcactgcctctgcctctgcctctgcctctgcctctgcctctcgctctccctctctgtacggtgtccctctgatgcccagccgaggctggactgtactgccgccatctcggctcactgcaacctccctgcctgattctcctgcctcagcctgcctagtgcctgggattgcaggcgcgcgccgccacgcctgactggttttcgtattttttggtggagacggggtttcaccgtgttggccgggctggtctccagctcctgaccacgagtgatctgccagcctcggcctcctgaggtgccaggattgcagccggagtctcgctcactcagtgctcaatgttgcccaggctggagtgcagtggcatgatctcggctggctacaacctccacctcccagccgcctgccttggcctcccaaagtgccgagattgcagcctctgcccggctgccaccacgtctaggaagtgaggagcgtctctgcctggccgcccatcatctgggatgtgaggagccccctctgcctggccgcccagtctgggaagtgaggagcgcctcttcccggccgtcatcctgtctaggaagtgaggagtctctgctcggccgcccattgtctgggatgtggggagcgcctctgccccgccgccccatctgagatgtaaagagctcctctgcccggccgtgaccccgtctgggaactgaggagtgtctctgccccgccgccaccccgtctgggaggtgaggagcgtctctgaccggccgccccgtctaagtgaggagcccctccgcccggtagccgcccagtctgggaagtgaggagagtctccgccctgcagctgccccgtccgggaggtggggggcagcccccgcccggccagccgccccgtctgggaggtggggggcgcctctgcccggccgccaccccgtctgggaggtgtacccaacagctcattgagaacgggccatgatgatgatggcagttttgtcgaatagagaagggggaaatgtggggaaaagaaagagagatcagattgttactgtgtctgtgtagaaagaagtagacatagaagactccattttgttctgtactaagaaaaattcttctgccttgaaaaaaaaaaaacagaaaaattatgcaatttttgaaagaaagggttaatttcatacaattgatctgtttattatacaatatcaagtgtaaaagcagaaatacaaaaatgtttttataacacgtaatccagtgtttgagaacctacaataataaccacagaactatagcatacacaatatagtaaatttttttcatatattaaatatgattcacgtttcttggggtgactatagttttctcactaatagaagaacagtaagttgattaaaccaaaaatcatgacacaattatatagggaggaagtcagagcactctgttcttaagctctgctctagggagaaactatttaaccagcctaatgtgctatatacagttttattattatctaactgactggggaaagagaaatactcaactccatccagcactagcatccagtcccacctacatgggtggagaaagaagcaaagagacacttgtgatgtttacagtccacagacataagctcactaaagcactgaaccctaagcatagaagtatagaatgtttctcttcccctacaccttacccccatattattaaaggcctatttctagcacttcccttcacccaatatattttatctggctatcaagtaaaaattataaggcataataaaaggcaaaaagacatggtttgaagataacaagcaagcttcggaaccagacatggcagggatgttgtaatttttaatagaggagcaatgtaaactgaaagatgaagatcccaagaaaaagcaaaaaaaagaaaatgctagagattaaaaaacaaaactaaacagaacactgtaacagaaaggactgggtatggctggaaaaacaaagtctgatcttgagagtatattaatagaaatctccaaaactgaagagaaaagagaataaagactgaaaaccaaaggcccaagaactgtgagacatatacaaaaggtgttacattgtttaactctttttctctttagaaaaaaaaaaaagtgcagtttgctgccagcattcatataattttacataaacacactctttgaggctgaagcaaatctgactgattttcaatgtgaaataaaatataaaatccgttcttggaattatttctaaacagaacttgtctctaatcctaatataacagaaatgtatatgataatcagtatttaataattttttgtgtggtaaatttcaaagcacagaacaacataaagcggaatatcacattccacacaaaaatatcacgtttctcttcagattgtcttgctaggctcgtctttgcacaagcagcaaactttgcagtgaccagttggatttcgctcccctgatgttggtgatatctcttggggaaaggtcttccatacaggtgaagaggtatgacatcatcagagcaaggatgacctggaagactttgctgccctggcctgtgatgctttaagagcattttttcaatcaacgtcagtctgaagtttatatggctaattgtgtgctcaggattgtccttcttgaacagggtgtagaggttcattcagcactgtaatgtttagaaggtggtgaaagaatttcttagaccgaatcttgtgccctttgaagaagtgagcatcaaatcagctgagtccactgctcccatcttctcactatagtccacagtggcatatgacttcttagttttctctccatttctgttgtctacttcaatcacagtatcattgtggaatgttgaccacattctcaccttcttctttttgaggtaaacactgtagctgcaagtgctgccagcaagtattcttgggcaaaaggtaaatgggttaatggacatgaagaaaaaggaggaggacggggtggaggcgtggtaaacaaaaccatattgagtgaaaatttttctaaattaatgtcagatatcgaaccacagatccaagaagatcaggaaacaccaagcagtataactgccaaaataagcaaataagcaaaacaaacaaacaaacaaaaacaaaaaacacttgagcatataatttttaaactataggaagtcaaaaacaaagaaaaagtattgaaaaggagacagagagagagagagagcatgaacataagagaaacaaacctttcatgtagaggagcaaatataaatattgcatccaacttcttctgtgaaacaggaagcattcttcacttcaatgcaagcaagaggagagtagagtgaagtatgtcgtgttgagagaagaaaaccaccaacctaggattctgttttctatgaaatcatccttcaaaaggaaatgataaatgatggctttctcagacaaacaaaaattcagaaaaatttgttgccagtaaacatgctttgtaataaatagaaaaagaaaagttcttttgagagaaggaatatagtataggtcagaaatttgaatttacataaaagaagagcatcaagaagaaataagtgagggaaaaattaaggaacatatttttcttaactgatataatttttttcaaaataatagtaatgtgattattatgcatgctgatgtatacatttacatatataaatacacacgtatgcacatatatgcatacttatttatacttacatataagtgaaatgaatgacaataatgcaacaaatggaaaaaattaggaatactttgttattatcaggtactcacatgacctatgaaatggtataggagtatttgaaagtaggcttggattagttgtaaatgtatattgaaaacttcagagcaacactaaaagaggttaaaaaatctaatatgctaataaaggagagaaaatagaagcgcataagatgctaaattaaaaccataaaaaagcagaaacaagtagaagataaacatagaaaaaaaacacaccaaacaataaatcgaaaacagtgaaagtgtggtagacattaatccaaggcattgataattagttggagcatcaagtgtctaaatgtacaaattaaaagatatgttattagagtgtatcaaaaaggaagattcaactatatggtgtctataagaaacctaattaaaatattaaagcacatatagattgaaaagtatatgaatggagaaagatataccatgctaatattaatcaaaagaaagcacaagtagctatattaattttggaaaagaagatctcaaagcaaggaaatttatcatggacagaaagagcattacatatgaaaaaggggccaattcttcaagaagacaaagcagtgcttaacatatgcgagcttaacagcagactgtcaaaataaatgtggcaaaaactgatagaactacaagaaggtacagctgagtccacgattacagttaaagactttaacacttcactatcagaaatgggtagatccagcgggctgaaaacccataaaaacagtcaaactcaacaacactatcaatgaactatgtataattgccatgtgtacactattttgtccaaacacatattttttcaagatcacatggaatattctctgtgataaacttaatgccaggtcataaaacacacagtaacgtattttaaaaaaatagaaatcattcagtgccttctctcaaaccacaatggtattaaaatacaaatcaataccaaaatgtagacaatacccaaatatgtggagattaaacagcacacttccaaataacaaaagagttaaagaagaaatctcaggagaaatttaagaagattttgaactaaatggaaataaaaacatgactcatcaatatttgtggaatacagcgaaagaggtgctgagagggaaatttatattatcaaatgtataaattagaaagaagaaaaatctaaaatcaataatctaagctttcactgtatgaaagtagaaaaagaagataaaattaaatctaaattaggcagaagaaaggaaataaatattagagcagatatcaaaaaaattgaaagcaggaagtcaacagaaaaaaaaacattaaaagctaatactataaaaatacaaataacattgataagcctcaagccaagctaaggaaacacagaaagcacacacattgctaacagcagaactgaaagaggggacatcactacagatcctatgaagcttaaaaggatactgtacgactattataaacaatgctatgatccaaacttgataactttgatgaaatggatgaagtccttgaaagaagcaatctaccaaaactaactaaaagaaatagacagtataaactgccctatatatattttatatatttaataaactgaataaataactaacaacctttttaaaaataaagcaccagattcagatggattcaatggtgaattctaccaaatatatgaggaagaaattcttcaaattctccatctatttcacaagatagaagcaaagggcatacctcctaagtcattctgtgagggaaatactagtctactaacagaaccaggcaaagacattacaagaaaatagaactacaaatatttctcatgaacatagatgcaaaaatcctccaaaaagtattagcaaatcgactatgacaatgtataaaaaaacactatacagtatagtatgccaagttggatttatgctaggtatgaaaggctgattcagtagtcaaaaattaattgatttaatccaatgttaattcttgtgcatccaacacaattgagtatccagagaatgggatattatttatagcctaaataaacaagctatcaaaccacgaaagaacatggaggaaatttaaatgcatattactaagtgaaaaagtcaatctgagaagactgcatattatattatttcaactatatgatgttctgtaaaagacaaaatcatagagacagtgaaaggatcagtggtagttagggatttgggagggtgggggatgaatgggggaggtgaacagagaatttttagggcagtgaaactgttatgtctgatactacaaagatggatatttcctattatacatttttcaaaacctataacatgtatgacatcataagtgaaccctaatgtaaactaagaagccctaatctaaactctgggtgataatgttgtgtcaatgtaggttcactatggtgggggatgttgataactggggaagctttgcctgtgtcagagaaagatacgagaatctgcactttcttctcaattttgctgtgaacccaaaactactctaaaaatgagctctttaaaaacataacttcctcccctgcccggccagccgccccgtccgggaggtggggggcagcccccgcccggcagccacccagtctgggaggtggggggcgcctccgcccggccgccccatctgggaagtgaggagcccctctgcccggctgccaccccgtctgggaggcctaccgaacagctcattgagaaccggccatgatgacgatggcggttttgtcgaatagaaaggggggaaatgtggggagaagagggagagatcggtttgttactgtgtctgtgtggaaggaggtagacattagagactccattttgttctgtactaggaaaaattcttctgccttgggatgctgttaatctataaccttacccccaaccccgtgctctctgaaacatgtgctgtgtccactcagggttaaaatgattaagggcggtgcaagatgtgctttgttaaacagatgcttgaaggcagcatgctcgttaagagtcatcaccactccctaatctcaaatacccagggacacaaacactgtggaaggccgcagggtcctctgcctaggaaaaccagagacctttgttcacatgtttatctgctgaccttccctccactattgtcctatgaccctgccaaatccccctctctgagaaacacccaagaatgatcaataaatactaaaaaaattaaaaaacaaaaaaacaagaaaaacataacttcttaaaaaataattagttatttccactatctaatacagcaacttgaattgtgggagaatgagtaacagtgaaagatttgtcatattttcttttattataaatcaattattaaaaatattattcttacaaaataatcttttttgaatttcagagtattgctattgccagtaaaagttaatgataaacctttaaaaagtctgccttgtaattggttattttgtctcaaaatctgttgcccttaagtatccagaccatgtaaacttttgtaagaattcttctttcatcagaaaaaggctttgaaattttcttatactatctgggagtataatattcttaattctaaatgggaacctcccctttctgtatgttaacataccgtgccaaaatgttgacaacagcagctagagtggatcactccacactggacaaagataagaattgataaagtttgtaagaacagcctatgtttagatctaggtgggaagcaggccactgtgtgtctccaatcttggtcacattcaactgcatgaggacagacttatataggtcagttttcttgtagttcaactttcttgccaaatcctgtttgggggtccataagtgtaaaagcacatgtaatatatatacatatataatatgtatgtgtgtgtgtaataatatatatattacatgtatacatgtatatatacatgtaatatatataccttatatatattctctctctctctctctctctctctctctctctctctatatatatatatatatatatatatatatatatgacttgggaaagaggagtcttggaagtggaattgcttgtgtccattaagctggattcagtgttcgtagggtggagtttgaccctatttgtaggggatttgggggcttatcaaggaaaaagaggtgaccacagagtagcagtagcacacacatttattgggtgaaactttgaggggctcacagggacaagtccttcacagcaggagtctttgcagatgtgaaggtgccaggttgctattcagaaaggaagggaaacaagaaaacacctgaggaaagggacactggagaaaggggcttatgtgtctaggtgatgtcacacagcagcatgatggagagcctctgggttagaaagctcaagaggacagttgcagtttgggggttttattgcctgaatcttactttatttattggcagcaggtgaggtttcctggcatatgcaaagcaagcagtgtctaaatggcaaaataataataataataaaatttgagggctatttttgaaataattagttgtgtaaaatttgaacttgatgatagtagtttaaaaataaacctgcagtttagcaatacacaactttgagggcagtaaacagagctttgattcatttatataacactgttgcacatcctataatgtttgttctgttgactttatcaacccaaactgtccaaacctataatgctttgcactagaatacatacccagatgtgtggttccttcccatacccaaatggaggttccttatggcattgattgtggtgatggattcatgggtgtgtactaattttcaaactcatgaaattgtgtacattaaatatgtacaattttttggtatgtcaattatctcaataaaatggttttaaaaatctcaactagcagagggatattccccaaatgcagattgtctagagtggattcctggcttcaagacacttgtaatgaaagctggttgtctcttctaaataactataaattgtcacccagaagaagtaaaattcatggctaaccattctgttttacaggttcagagcaggctttgtggatgtgtttatcctccgaatttatatattctctctaaacactgggagacgttagtatgtttacatgtctgacttctctgggttgtcaagatcccatttttgatctacctaatatgaatttgtatccaaatgtttaaattcttttctttccttttacttgaagtaaatactaaaaaatcctacagagatactcaacccaaccataaaaatgagtttgagaatcatgtgttggcgatgaaggctttttatctgtaaatgctaaactttctgctgagcccagctcacccatggactaactggataaagtgagacaataattccattgtctacctgagcattccccaccttaaaatttttaactgcctctaacatctctgctctaggcttactcttgaagacagggtcctctatcttgaaaagaagtttttctcaaaagccagagcttgtttaataattttcagtttttttaatgtgagatttgtctattccaccttgtaagaaaatttgatttgccagacaaatgaaaagtggaaaactcaagaagagtttagagatagaatcaaggacaatagcattttaaactgtgggtacatctgtctttgaaataatttgtataaatatacggaaatgacaaagtaaataatttttttgtatttttaatttagataagatagtttacttgcagaaaaatggagactatgaacctggaattctcaaattcaatgttttttcttccggtttaaataatttcaagaatctataaaatacttacataaactttaaatacagaaattttaagagcttcagaaaaaatcgaccaaattaaatcccttacactagtttctgaaatcaaccaaaattgtgttttaactactgtgttttatttccaatgaacaacaatcaaaaacattagataaagtaagatgcaataggtgaatgaattgtttggtggtcactcttagttataatgagataataatgagacaatatcttcatcagaaagtggaaatggtgactttctgccttaagggagcaggggactcacagttgtaaacttcccctccgtcttgatctttcttgtgcaggagccgagggtaatccactgtttcagtggtctttgagcagcaacagtcctcatctttctgtaattctagaaatgctcatactgggctcttctaaaacactttttatgctaaatagaaaaataaagatcagtaataaaataaaaagaaataaaataaaataacttatgaactcctggaagtagttgtgggataaaattataaagtttaacaaaaaactagaacctagaacaacttactaaaaactaatttagtcaaattttactcttattttgtattcttgccctcacaaattaggaattttctcaacccaaagaatgattgcctttcttatattctggaatcttaacagccataggagaaatttgaaactatgagaatttatactaaccagttatcctaggaaatctggttacacaaaaattaactatttagagtaaaataaaaggaaaaatttgttgatcccatggaaataattaactgaatatttgctggtcaataaagctaatcctaagtatgcccctaaataacagcgacatcgttgtttctggattaatgctaagttttcaagatccattaaaagtaatttgccttggattcagactcatagtattggtcataactgtaattcaactaccaccagaacttgtagaagacaacaacaaaaaagaaggggtaatgagaaatatgttatgaaatgtatcccaatgttaacatttatgaaggagagggaggtgttttatgaatatctattctcatagcactgatatcttcaatttgataagcaaatacaaatctttaaaccagaatttggaacagggtaaatatggctctcatgaatttgacttgactgcgtcctggggttgtattgacataaggactagatggaggtacatacagcagaagtaatgaaaattataatgtcaaattttagagcctcctaactaaagcactagctcagatactgtataaagatgaaaaaaaagttatgtgaaaatgccctggaactgtttctggactgcctagtaacatcctggctgtggttggatggctgatttaccccagctggaagtatcagtattgtacagctgaaatttgtgggcactctcctctgcagttgtcaccaaatggcttatacttttattttcaaaatccacttgcaattctaagagctctccttttctctcacaaaaggcagttgaggcaaatcaaagacttttgggataaaatgttatctccactatgaattgacaaagtctatttagatgtttgcaaactaaacattttcactaattgctgtgagtcacactccccctgagtatagcttgtgtagaatgcaatcacaggtatgtaagtggaggtttggtataaccactaatggagaggtaggaagttagaaagtgggaaaataccaatttctgaatattaccaaacgttatcgtgttaaaaatataacaaaacctgctaatcctaacatatacccaacctttgtagccatgagtaggcctcaattttcttgctgttatgctgactaaatctcattgacaaatgcaggaaacacagggaggatcagaatgcactttccaggtagctctctcttctgtcatgtctagttgctcagagagcactttgatcaccttcattcttctgcttgagccatgtgaaataaggctgttacagtgatggggccagaacagtctggatcttcctgcaaattattccctgcagtcatctaacatctacctgtgaagccaactcagaatctgccatgcagacagtccacgtgcaaacacttgtggatggctgggccatcccaagtagggaggtttgtgttcagggttttaccactgtgtgaggaccttgcagaccctgttcacagcaataaaccccaacatcctcagcctccactttgctgaatttaagtgtgaaacctgtccctgacctgctgccactgaacttgtttgggactccatagaatttgttagaaattgtgtagataagaagctgtggagactggcctggcttctgcaggtaccaatccaaataggtgtttccatcactatgcaggaggctctgactagacctgcaggagatggaggccggctctcccagagggatgggcagggagagcagatgctgggtcatcacaatatccccactggatcctaaaataataacagtgagaagtacaaggttacatacaaacaatgtgagacatttttataatttagttttattgtatacgttaggctacttttttgtgtttgattagattcatacactacatttatccaatatccaaaaataatccaataattaaaggcacaaagtggcctctttgtttttgaagttctcgacagtgaagttctttttccttgtggctcgttcttagttcttacaggtctgaatattaaattccctttgctggaggacaagaaatctgcatctgacatgtagacagaacaacaaatgggaggctgcagattccacagagctcaccctccagtcccattctcctctcttctgtccttaccagggacccagagcattagcagccccaggagctgagcagggagcctcactgtgagaaggtgaactgaggagtcctgatcagtcaaggcaaggttagagctgagcttttatctcagactcacaagggaaggtcttccctaggggacaacatgcaaatcccctggtgagtgaagcagtgaagaaatatccagttggggtcgaagagtgggcttcttatgtaagcaaagtgacacagaatatcttttgtgttgatgaaaccaaaataaaatattggtgttgcctggcttagaagggtgacattctgaaataccatgaatcaatgtggaagacactgtgactgcagcctgtcactcttcattgctgatgcaatggagattgtgatgatgaagatgtgtatcaatctttaggtggtgaataggctttcttcttggctccacccagctaattctgaggaggaactagctctcactaactctggt

SEQ ID NO: 828 - DNA, 20565 bp, Homo sapiens
gggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaatt

SEQ ID NO: 829 - DNA, 686470 bp, Homo sapiens; identical to SEQ ID NO: 48

SEQ ID NO: 830 - DNA, 394197 bp, Homo sapiens
tccccaaataactcaatgttcaaatgctagactacccatataacataggatcatctgagaatttcaactgtcaaaaaggaaatatgtctagatttggacttaggaagttgcagataggtgagtcatattctctccaaaaaaccatctttttggtttgttgaaaaacttagggagatttttcaagaatccataactaaaggtgatagagggtaggtaagtgttattttttccttttgttgatagaataagaacagaattttatgcccaattaaaagatttcatgatatgagttgttagaatatacaagtgtttcctattttcactgcattaattttactaggatacaattgcataacaaaattcacaagcagctgagaaatgttatactaatatcaggcaggcatagcagcctgggagcattttgcacgtgtgatactttagtcatcaaatttgtactctgaattaagtgtacttataactggtacttggacaagacactggtcatttgtacaagtttccaaacatagtgacactgattagaaatgcccttgttccagagacagccaatagaaagatgtgtaagattttgttttaatgcaaatagtaataatgcatttgataggcattgtacatagaaaatgacttagggattattttgccatcatttcatttcttataagaatggtgaccccttggctaaatttcatgttaacaatgtttctcatttactttggtcttataatttcagctgctctaaaataaatcttagataaattcattgcctactttgacatacatattttaaggcttcaaattctggaaagatctaaatgcctttaaatatcttgtttttagctacgctatgatcacactattttatcattttaaaaggatcagtgttatctaactgaggtcaccggcagaatgaaaagtcaaggtattagcatttatattttcaactgaattgacagagatctcaacaatgagtcattgaggggttattaagttcaggagctaataatatttctctaatatgattgctaaaaagtcaatgggatttgtaatttataacacaatcttgataaaatacaaaatagaatagctgttcccttaagacatcaacagttagtgtatgaagcatgtcacttttgtgttccaaattttcactcatattaatttgctcttattgaaattttgaaactgacttagcttcagtttggtttcacagatatatgtattaggcactttatcctttagggggactcaagcctctgaagatgatgatgccattgcagccaaattttacattcaaattctagcccaagactactgaacttataaagttgaggacactattataaaatattaatgattcaattctacttcaaaatttcatcttaagtaaaacaaataaaaaataaaaattatatatagctatcttaaaacaagcataattcgatatcccatggatatctaatcaatgaaataccatgtgaccatgaagagttttctattaatcacatggaaagtgttcataatgtattttacttggaaacagagtttatcacacctttagatctgaaattcaaaaagaaatgtttgaaaaatataaatagtcataaaggcagacaagtaaatacatggagcagagggggaaaagagatgagaaatttttcaacagaacaattttatgggaatagtcataaaggcagacaagtaaatagctggagcagaggggaaaagagatgagaaacacaaaggataacaatgttattatcctcaatttatttatttgtgctttttacagtttttcaaacacttaacataaattgtattgatatatatataaagaacaaaacgatgctataattattaaaacaattaggaattttaagtcatcttatgtttgttccttttatttttatttatttattattattattattatactttacgttttagggtacatgtgcacaacgtgcaggtttgttacatatgtatacatgtgccatgttggtgtgctgcacccattaactcgtcatttagcattaggtatatctcctaatgctatcccttttgtttttaaagaacctgaaatccaaagggcaatgacttaccacaaggagtaaagtgtcagtgtgggtgcagaaaccaaaagccagggcttcatctcatggtctagtgttgacttcactcgacctcaatgccttcctccttccttcccctgccagtttggttccttattagtagttcttttctaggtatcttaagcttggaaccttcgtaagaaaagggacttgaaatgttcttacacagaaggtaagaagaactttacaaattctctgagagtttgaggagaaagaaaaaatgttaaggggctggccttattaaaggtgggttaactttgagctgtatatttgcacagtaatatatactgtgaatcttagaattaggagttgtaagaatggaaacttaactaaaggtttattttgtgtgacactctaagattgtagtgtcacgtttaattccattttgttcctaagttaaagtgaaagggcatttttaagagctttgctgatttatgaatagtcaagcacatcacatattaataggatgtgtaatatggaagttgctattcactgttaaatatggtggagaaattagtgaaggaatgggtagaaattttgataaataatccattccccccccccacttgctggctttcttgaattgatagccaggaaaggtagaaaaaaaagaggtatgtaaagtcagactgaactggttgcaaactggacttcatgacttgctacatgtgatcttgatcagattacctaaattctctgagtttaacataagtttgcatttaaggggatgagggcgggagagagagagagagagagagagagagagagggagaaatataccactagtcttttgtctgtggtaagtgttgcaaatattttctcccagttcattggctgtcttttgattttttgtatagtgggtttttttcctgcaaaattttaaaaaatgatatagtcaaattcattgacatttttcttttattgcctctgaatttgagtcatagttagaagaccttttcttacaccaaggttaaagatgaatttttcaagtacttgtttgattttattttttacaccagaattccattccttttgcagattattcttgcatatgatataagatatggatctaaatttaccttttccaaatggctactttgttgtcccagcagcagttattaagtctatttttaagtggtttgaaatgctgctgttgtcatatactaaattctcatatgtatttagttttaaatttggaccttctattctattccactgctttatctgtctattcaatatgatgctagtataacatcattttaaatataaaggctttgtagtatcttttaatgtttagtaaggtagtcttcctcttatttctttttttacaaaagtattttccttgctattcttgtatgcatgtgattccatgtgaactttagtcaatttacctaacttcataatttgttggtatttttattaggtttgaatgaattataagtcaacttatggagaatttatgtccttatagtgttgagtcattttatccaaaatacagggtattttcctaatttttaaagtcttctttagagtcctttgtgagtgttaaaattttcctttcacaaactttgtacatttttattaaatttatttctaagtatttagtgttcttattgcttattcttattatagtgttcttattcttattcttattcttattatacatggacttactcttaagttctctaaatgttcgttgttaaagagtatataaaggctactaatttgttaatgttaattcagcattcagctaattcactagaatatttgatttcttgagatggttttatcattgaccctctggaattttcaaggtttattatcttaacaactgcaaatagaagtagttttacttcttctttaccaatttttatgcttttcaagaatttatctcatctaattgggttggctctcatcgaagaactgtagaataatatgggatcgtattaatcataacatgtattcttgcttcgtctcaaatcttaatgaaaatgcctctagcgtttcttcatcaaatagtataccggctttaagtttaaggcaaatatatttcattatgttaagaaaggatccctaaattctttttctttgagtttttttaaaacaataaattagtgttttttgttgttgttgtcaaaggctttcttagcatctgtgaagataatataattatgcctttaaattgtcaacatggtatatatgaaatgaattgggtttataatagtaaaccaatcttgcattcctaaaataaatcctatttagttatcgtgtgttattttcttaatacagtgttggattaagtttgctattttttattttaaaattttacattattttcttcagtgatattgacctgtagttttctttcattatactgttttatcagatttaggtatcagtgttatagtttcttcatgaaaggaattaagatgttttccttccctttcaatgttctgaataatcatacagcattatgactatctgccatttaaatctttagaataattaccttgtgaaactatgtgggcttggtgctattttgtgtagtatttatctaattgtttcctatatttcttctatgaaattggttgatttaatctttctaacactaataagattaatttgagtaaacttcatttctctagaaaataattaattcatcaaattaaatcaaatttgaaatttgatttcaaatttatttgtgtcaaagtaaaggaggtttcctgtcattttaaaattctctgttgttttaatagtaacttgtttcttattatttataactttatatatttgtactttttccttttttatcaaatgaactgagttttaacatcgcatttaattttaattatctaatctaaatctaaaagctgatatttgattcaattgtcagaaatctcttaagtatattgggatcaacttggaaaagtaaattgactttaaacagtacactttatgaactttaaattacagatcagatatttttagtaaaattttatccaaactaagatgcaatatgagtataatcactgattcaaaaagcttcctttagtgagcatgaaatatctcactattttaattttaatattgattgtgtgttaaaataataataattgcattatattattgataatgtgtattcttgtcatgtttccattcttactggaaatgcctccagtgtttctccatcaaatagtatactggctctaagactaatttaaaggacaagatggccaactagacacagccaggaagcactgttcctacccccaaaagaccaaagtttcaagtaaaccaacataacttggacagatcttcaaagagaaaatgcccagtggatgaagatgtgatgcagatgtggaggctgaggaggtaggaagctgggaaccttgttcagggtaggccaatgcttgagccaatcctgacctcaagtggctcctgggaatgggtgaatgaagaactgcaggactgcctaccctagccatggaccgctgggatcctggctatgggggccccacatctgccatggacatttgagctggcagaaggatccttccagagagtagacagagatggagctccagccagcatggaagcatgggcctttgtgcacagtgaggctgtgtccaaacatggacatagccacctattccccagggctccccactcaccgtctgagaagctctagctccagttgaccaccaggctaggaggaagctgggctgatttctctgtgggactggtacgtgtctgttctttaggccctcttgcccaccagcccctccaagggccactgtccagctgctctccaagagagtatgcatggctcagcttccactgcccagcctggttgctttgctccacctgattatgttcccggtggcctgggagcactttggattcccattacacctggaacctgaatctaggggtccagaggatggagctgcaagccaatcctggtgccccagagctgcagtgtgcagttcagaagcgcagagctgaaatttgtggccagcactcaagtgggagaagagcccaccctcttagaggactaagaggggtgacttgtgtcagttcatgagctggaatagaagcagaacatgtcttcttcctcagggccaaccaggaaagagtgttacctatctccctgctacgttctttgcccagggagcctcacgtcccagaacagctaaagaaagtaatgcaggcacagtgccagtgatcagaaggggctccaccaaggcccaagttcagacttggtgaggaattacctctctccccactgcactgcagagtgtggctggaaacatgaggaaatatagaggagctgggtggctaagtaagagactatttactgtccattattcttaagcactatccactggatcacagcccaaacaataacaccaaaaatgttttgctgatataccctgctgtaaaaccaaggacaaaaattcagccacaaataaagacctgtacagagcctagaccatctgaaaacattcagaaacaaagccaattggctatactcaacttatactgtagttaaaggaacagcaaccctcccagatgagaaagaatgtggacaagaactctggcaatttagaaaggcagagtgtccccttaccccaaaatgagtccactagctccatagcaatggtgcttaaccagtgtgaaatgacataagtagaattctaaatctggatggcaagaaagttcaagaatcaggacaaagttgaactaaatctaaggaatctagtaaaacaacccaatagctgaaagatgaaataacatttcaagaaacaaccaaactgaacttctagagctaaaaagttcactacaagaattccattatacaatcagaagtactaataggaaaacagaccaagctgaggaaagaaaatcggagcttgaagaccagttattcaaatcaactcagtcagaaaaaaataaagaaaaaagaagtttttaaatgaacaaattctccaagaattatggtattacataaagagatcaaatctacaactcactggcattcctgagaggggagagagaataaaaaacttggaaaatatatttgagaatatagtccatgaaaatttccctattctctctagggaggttgacatgcaaattcaataaatacagacaagcccagctagatactatagaagatgaccatatccaacgcatatagtcatcaaattcaccaaggtcaacgcactcacacaaaaaaaggcagctagagataagggacaagctacatacagagggaacctcattaggctagcagcaaacctctcagcagaaactttataagccagaagagaccagggccctattttcagcatccttgaagaaaaggaattccaaccaagaatttcatatcacaccaaactaagcttcataagagaaggagaaataaaattcatcacagacaagccaatgctgagaggattcatttcatttagaccagctttacaaaaataccttaaaggagtggtaaagataaacacagaccaggtacagtagctcacacctgtaatcctagcactttgggaggccaaggtaagtggatcacttgaggtcaggagttcgagaccagcctggccaacatagcaaaaccctgtctgtgctaaaaatacaaaaattagcccggtgtgctggaatgcacctgtaatcccagctacttgggaggctgaggcaggagaattgcttcaacccaggaggtggagattgcagtgagctgagatcttgccgctgcactccagccttggtgacagagcgagtgtctgtctcaaaaaaaataaaaaataaaaaggatgaaataaaacaatgacacctgctaccacaaaaacatacttaaacaaacagcccacaggcactataaagcagctaaacagtcaagtacatacgacaactagctaacaacacaatgacaggatcgaaatcttacaccaacactaaccctgaatgtaaatggtctaaatgccccacttaaaagcttggagtggcaagctggataaaaggacaataccctatcatgtgctatcttcaagagacccatctcacatgtaaggacaaccacagactcaaagtaaaaggatggagtgagatctaccatagaaatagaaaactaaaagagcaggagatgctattcatgcatcagataaaagactttaaaccaatgaaaattaaaaagtacaaagaagagcattacataatgataaagggtaagatccaacaagaatacttaactaccctaaatatacacacccaaactttggaacacatagattcataaaacaagtttttcttgggctagaaaacacttagacaaccaaacaataaaagtgggggacttcaacaccccactgagagtattagatcactgaggcagaaaactaacaaagaaactctggactacatttgacacttaactaattggacctaatagacatgtaaagaacatctcacccaacaacacagaatttgcattcttctcatctgcatatagaacatattctaaaatgcaccaaatgcctggtcataaagcaagtctcaataaattcagaaaaattgaaataatacaaaccacacagtgcaataaaaatagagatcaatatcaagactatctctcaaaactatacaaataacatggaaattaaacaacttgttcctgagtaactcctgggcaaacatttaaattgagaccgaaattttaagacattatttgaaattaatgaaaatagggacaaaacttaccaaaatctctgggatgctgctaggaaagtttatagcaccaaacaccatcaagaaattagaaatatctcaaattaacaacctaactttgctgctaaaggaactcgtggaaaaaagaactaatcccaaagctagcagaagaaaagaagtaactaaaattagagaagaaatgaatgaaattgagatgcaaaaatttatacaaaaatccataaaaccaataactgtttttttcttccaatagtttttggggaacaggtggtttgtggttacatggatgacttgtttcatggtgatttctgagatgttcgttcccccgtaacagtagctgtgtacactgtacccaaggtgtaatcttttatccctcacccctctcatcctttcccctgagcccccaaagtctgttatattattattatgcatttacatcctcatagcttagctaccacttataggtgagaacataacgatatttggttttccattcctgagttacttcaacttgaatgatggtctccaactccatccaggttcccgcaaatgccattattttgctctttttatggctgagtagtatttcatggtatatatacaacacattttctttatccactcatcgttgatgggcatttaggctggttccatattttttgcaattgccaattgtacttctataaacatgatgtgtgtgaaagtgttttttcatgtaatgccttcttttgttttgggtggatactcagtagagagattgctcgatcaaatggtagttctacttttagttctttaaggaatctctataccgttttccacagtggttgtactagtttatattcctaccagaagtgtaaaagtgttcccttttcaccacatctacgctaacatctattattttttgatttttaaattgtggccattcttataggaataaggtggtatctaattgtggttttgatttgcatttccctgataattagtgatgttgagcattttttcatatgtttgttggcatttgtatatgctcttttgagaattgtctcttcatgttcttttcccagtttttgatgagattatttgtgtttatcttgctgatttgtttgagttccttgtagattctggctattagttctttgtcagacacatagtttgtgaagattttctcccattctgtgggttttctgtttattctgctgattatttcttttgctgtgcagaagctttttattttaattaggtcccatctatttatttttgcttttgttgcatttgcttttgggttcattgtcaataaatctttctttaagccaatgtctagaagttttttcgatgctatcttctggaatttttatagtttcaggacttagatttaagtctttgatccatcttgagttgaattttgtataagatggaggatgatgatccagtttcattattctacatgtggcttgccaattatcccagcaccatttgctgaatagggtgtcctttttccacttcatttttttttgtttgctttgttgaagatcagttggctctaagtatttggcttcatctctgggttctctactccattccgttggtctatgtgcctatattttataccagtaccatgttgttttggtaactatatccttgtagtatagtttgaaattgggtaatgtgatgcctcaagatttgttctttttgtttagtcttgttttggctatgtgggctctttttgcttccatataaattttaggattttttttttctagttctggaagaatgatgtgaagaatgatgatggcattttgatgggaattgcaatcaatctatagagtgcttttggcagtatggtcattttcacaatattgattctacccatcagtgagcatgggatgtgtttccatttgtttgtgtcatctatgatttcttcagcagtattttatagttttccttgtagaaacaaggagttttcacctccttggttaggtatattcctaagtattttattttattttttgcagtggttgtaaaaggcattgagttcttgatttgatcctcagcttggtcattgttggtatatagcaatgctactgatttgcatacattaattttgtatcctgaaactttactgaattcatttatcagatctaggtgcttttaggatgtctttagggtttcctaggtatagcattatataatcatcagacagcaacagtttaatttcttctttactgatttggatgccctttatttctcttatctgattgctctggctaagacttccagtgctatgctgaatagaagtggtgaaagtgggcattcttgtcttgttccagttctcaaggagaatactttcaacttttttccattcagtataattttagctgtgggtttgtcatagacggttttgattactttaaggtatgtcccttctgtgccaattttgctgagggtttcaaacgtaaagcgatgctgaatttcctcaaatgctttttctgtgtctagtgggatcaccatgattttggtttttaattctgtttatgtggtgtatcacatttattgacttgcatatgttaaaccatctctgcattgctggtatgacgcccacttgatcatggcgtattatctttttgatatgctgttggatttggtgagctagtattttattgagaatttttgcatctatgttcatcaggaatattgatccgtagttttctttttttgttatatcctttcctggttttggcattagggtgatactggcttcatagaatgatttagggaggataccgtctttctgtatcatttggaatagttgtaagtttggtacaaattcttctttaaatgtctgatagaattcagcagtgaatccatttggtcctggacttttatgttggcaatttttgtactactctttcaatgtaactacctgttattggcctgttcagtttctatttttttctgatttaatctagaagggttgtgtatttccaggtatttattcaactcctctagagtttctagtttgtgtaaaggtgttcatagtagccttgaatgatcttttgtatttctgtggtattggttgtaatatgtaccatttcatttctaattgcgcttatttggatcttctctcttgttttcttcattaatattcctaatggtctatcaattttatcttctcaaataaccagctttttgtttcatttatcttttgtattttttgtttcaatttcgtttagttctactcttatctttgttatgtattttttcccctgctaggtttaggtttggtttgtttttgtttctctcattccttgaggtgagaccttagattgtctgtttgtgctctctcagacttcttgatgtaaacatttactgctatgaactttcctcctagcattgcttttgctgtactccagaggttttgacaaattgtgtcactattattattcaattcaaaaaactttttaattactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagctttatggggatggcattgaatctgtaaattaccttgggcagagtggccattttcatgatattgattcttcctacccatgagtatggaatgttcttccatttgtttgtatcctcttttatttccttgagcagtggtttgtagttctccttgaagaggtccttcacatcccttgtaagttggattcctaggtattttattctctttgaagcaattgtgaattggagttcactcatgatttggctctctgtttgtctgttgttggtgtataagaatgcttgtgatgtttgtacattgattttgtatccacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatagccaaatgactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaattttttttaacttccatcttgatttcgttgttgacccacagattattcaaaagcaaattatttaattttcatgtattttatagttttgagggttccttttggatttaatttccaattttattccactgtgtctgagcaagtacttgatataatttcaattttcttaaatttattgagacttgctttgtggcctatcatatggtctatcaggagaaatttacatgtgatgatgaaaagaatgtatattctgcagttgtttggtagaatgttgtataaataccttttaagtccatttgttgtaaggtatagtttaagtccattgtttatttgttgagttcctgtcttgatgacttttctagtgctctcagtggagtattgaagtcccccactattattatgttgccatctatctcctttcttagatctggtagttattgttttgtagatttgggagctccagtgttaggtgcacatatatttcagattatgataatttccagttggactaatgcttttatcgttatattatatccctctttgtctttaattgttgttgccctgaagtctgttttgtctaatataaaaataactactcctgctcacttttggtttccgtttgcatggaatatctttttccatcccttgaccttaagtttatgtgagtccttatgtgttagatgagtctcttgatgacagcagatacttggttggtggatttgtgtccattctgtcattctgtatcttttaaacggagcatttaggccatttacattccatgttagcattgagatgtgaggtactgttctattcatcatgctagttgttgcctgaataccttgtttatttttaattgtgttattgttttataggccctgtgagatttatgctttacagaggttctattttgatgtattttgaggctgtgtcaagatttggaactccttttagcatttcttatagtgctgtcttggtagtggcgaattctctcagcatttgtttgtctgaaaaagactttatctctcctacatttatgaagctgtgctgctgtatacaaaattcgtggctgataattattttgtctgagaaggcaaaagatgggaccccagttccttctggcttgtagagattcttctgagaaatctgctgttaatctgataggtttttctttacaggttatttgatgctcctgtctcacagctcttaagagtccttcctttgccttgctgtagatgagctgatgactatgtgcataggtgatgatctttttgcaatgaatttcctgggtgttctttgagtttcttgtatttgggtgtctagatctccggcaagaccagggaagttttcctcaattactctctcaaataagttttccaaacttttaaatttctcttctttcccaggaacaccaattattcttatgtttggttgtttaacataatccctaatttcttgggggctttatttttttattttttatttctttatcactgttggattgggtttatttgaaagccttgttttgacctcggaagatcttcttctacttgttatattctatctttgaaactgtccagtgtattttgcatttctctaagtgtatctttcattttaaaaagttgtgattgtcttttctttaaaatatcaatttctatggaaactttttcattcgtatcctatattgttttttaagtttctttaagttggttttcaccttgctctggtaccttcttgagcaactaaatattcagccttcttaattctttatctggcaattcagagatttcctcttggtttggatccattgctggatagctagtgtgatcttttgggagtgttacagaaccttgttttgtcatgttacccaaattacttttgtggtttcttctcattagggtagactgtgtcagtgaaaagatctggaactcaagggcttctgttcagatttcttttttcatggggtgaccccttgatgtggtgctctcctcctttccctagggatagagctttctgagagccacactgcaatggttgttgttgcctttctgggtctagccacccagcagggctactgggctacagactggtgctggggaatgtctgcaaagattcctgtgatgtgattcatcttcaggtctccaagctactaccagcacctatactggtggaggtgggaagggagtgaagtggactttgtgggagtccttggttgtagttttgtttagcgcactgcttttcttggtcggtggttatgtgtagttgtcacatggacagacttatgacctctggttagccagggtgttgcaggaggtggaattggctgttctccttctttggagcaagcttgttctgttatgagttacaataatggcttgagttggttggcctccatccaggaggtattaatttcaagagagcaccagctctgttagcagaaggggagtatacaagtgtatattcctgtatattcctggccctatgttggccagggtaagtacttgggtttctcaggtgatagcaagggccatagagctccaaagaggtttttttgtttgtttgtttgtttgtttgtttgtcttcagctaccagggctggtaaagagaagatatcagttgggtacagggttaggctgctctgagctcagactctccttgggtggggcttgctgcagtcactgtggaggatgggagaatggttttctggccaatagaattgtgttccttggggggattatgcctgcctctgctgcatcatacaagtcgcctggaagtggcctcacccagctcccacgcagccagaaaggccagtctcagtactaccaatcaccaccaacagcgctgagtttatatccaagcagcctgagagcagggctgagatctcaccccaggctacaagcatccccactgagaaaacaagcaaggctctcaggcctcacctctccccacctgcctgtaccatcagctgtggcttctacactcatatctgcacttactgttcaccccacccccacccagagtctgctcagaaaaagttgtgctcggtcaaaattattaagaagttcagctcgaagttttcttcaacctgtgacaccttctaaattcttctggctgccttccccaaggacccctgtgaggtaaaaccaggaatggcttccctgggctcaaggtggggactggtagtacctacggggactggtagtacctacagggctcttcctgctgcttcttctgcttttatatttcactctgattcctaaatccatttcagctctaggtaaggttaaatccttctcctgtgacctggacctttaggttccccatttgggatgtgtttgggatcagactttttctcctttcactctggaaacacgttttttttcagctgtctttcaaagtttgcagcagcaagctacttctttcaaagggtctgtgacttttttgggttttcctgatatgttcctgcagtggttttggagcaaaagttcacaatgcgagtcctccacatgctgttctgtccatccaagtgggagctgcaccttagtcttatctcttatccaccattttctggaagcttggaatacaaattcattaacaagctattcaaaggccaagacaatgtgactctaatcttgttttcagtaactccttgcaacactattctttagctatatggagatatttattgagcctcacacaagctcctactttatgccttccacatgctgtttgcactgccttgaattctctgttgcttctaatttgaattgtatgcattttaggatttctcttagatgccacattttatgcagccttttctaactctaccatgtaaaattaattcctgtgcattattttatttgaatctttcttgtgatactcatcattttttatttttcggtttccctaaaagtatgctctttgagtgaaacattcatgtttgtctttcacatttctttctatttacattcataacccattttaagtgctttttatacaaaaattattcattaaatatttgttcactgtatgtaaaaggttgacatctcagggtgaagagaattattaaatatttttgaagttggtttatataatattagcttttacacactttctgtaagtttttcaaagtattttttgtctgtcatatttgcatttatttgtttaaattatatttgtactatataaatgtttaaaaaaatcccttttaataaaaacttaattttatcttaagtgtaagctagagttagcttagctacttattaattgtttctaagttcaaaattactgatttgtaaacatgtattagaagatcacagtgttaacagagtggaatgaattatccacatccctcaagtggtggctgcaacttagacccatggattctgtactagattttacataaatagaagtcataagacagcatgtagtgtaaaggatgtttgttactttttttcatcacttagcatctataccatatatctttttttggataattcaccactttaagagtaagtagatggcagagattgactctgtagaagttgaaattagcacataccaacgttttattcatcccttgaaactagggcaatgtcagtcaatgggatgcttccaactgatcttgaaattaggaggtgatggtgcaaagaatcaccaagctgaaggattgactgagtatctactgcagaggtagacagtggcagcctaaacatgtgactttcagaagcaacagggtaaatggatcactgcggtagctatagctttgaagtctgtggcatatgctcttcagaaactaaatgtagttatcctcactgatttagttttatgaaaagatttttattgtggtcttcttggctgcctattttttcttaatcctctccatctttgagttcagttctctggacttcctgatagtactctgatcaatcaaacatccattcaatggattctctttggctaattctgccatagtcaattactgcagcaactgacaactatgactgttaaaactatactcttttggcaccattgctggatgtatggtatgcttacttcttctctaattttttcccttccttttctagctagataaatatttgtttagccttttcatatattttctttgtatcataatttgaactctcttctgaattatcaccagaatctccttgtacctcttcaatagtggagggccaaaactcagcacttggtgaatcttggtggtttaaaaaatggtaaagacatagtccactctactatttagtagttgtgtgacttttagtaaattaatgaaccattatttttcattgtaattctgtaaaatgaagacaatgttactgattttatgggatttttataagaattaaataatgttagcaaagaccaaagacaatagcacagttctcacacatagtaggcattcagcacagtgaatagtagttatcattagtaattctgtaggctccatattgcctaaggacctaaagatatgatatgtattccctgtgtgtgagataacaatctctatagtcaatttcagtttgacttatataatatccttgattttattttctcaaaattatgcctgtttacttggtacttgcttttaaaatggtattcaccgaagctttaacatccagtgattaacagtgagagagagtaaggctctttttaaaccaccagagtgtgttagggtagtactgagtcaaagtctaagagttttatggttaaaaaaacaaataactttttactgctgctcatttaagtaggattttatgttgttcccaagatgggagtctacaggcaactaataagcgggaagaagtgactgtgaagacaaaccagctgcatcaaactgcaggcacctcaggaatcagcagatcatgcagggcacaaagaggtgaaaccagtcaagtgtacagtggagacgatttctcaattttttttccttggaatactagcatcactcaaaaatgtcaatagtgtttggtgaacaaaataagctttttaaattaaatgtacagaaatccctgcttatcagaatgacaccttgaattttcataatacatattagtatacccaagtaaagaagcctgtctaatttttctgagatctttatttctcccaatttgctggaacatgttttatttttaatttgttttctttgatttgcttttacaggaactttgtaataatctaaagaacgcagttgctataatttgataatgacaaatgaaattatgaaggtaattctgagcaattgcgaaaactcacaaacaacagtctaaatatttggagctttatactctaaatactggggagccactaaagatttttaaagtagaacaatgaagaattggtgcattacaaaaattagttgacaatcatatttagactttatttgaaagataaggaaaaatgatagaggcaagggaatcaattgaccagctattgtgatatctcaattttgaaaaataattaaaaattagaatgaagggatctatgtaaaaggaagccaccaagagaagtaattaattcataggacatgatgattaatggatgtggatgaggaggaaaaaggaggttgaaagaaagtagtaaaaactggcaagagagtccatgtctgaataagaagataaaatgtcacactgattaatactttaactgaccaaatcaagacagtgagattgtttgtggaagaatattgcaaataatttaggagctttaaaattgtggacttattctgatgcctccacctaaattgtctggtatcaaaacttgctgatggttgcatcatgttccagctttccatcttgcattttctaactcagtaaagagttaaaaggtgatttaaaaaaaaaaaaaaaaacttcctttggcatggattatgtcagctttcatctacatgctatgcaaaatcatgtcttggttagtatttttcttatcttttgatggttgacatgcaagagagaattaaacatcaagataattagtgaatcctggtgatatggttcagctgtgtccccatccaaatctcatcttgaattgtagtttccataatccctacatgttatgggagggacccaggaatcatgagggcagtttcccccatactggcctcatgttagtgagtaaatctcatgagatctgatggttttataaatgggagttcccctgtacaagctctcttgcctgccaccatgttaagatgtgcctttgctcctccttcgccttccaccatgattttgaggcctctccagccatgtgaaactgtgagtccattaaccctcttttgctttataaattacccagtctcagatatgtctgttagcagcatgagaacaaactaatgcacctgaatactttagtgttttttagtagaatatgacatattatgagtacacaatgtgaagaaatccggatattcgaaagacaaacatttctgaatgaaggggaaaagtaagctggggcaagacaacgtttctcatccctgattgaaatgttcctatttaccccctaacttataccttgggatgttatgttgcttgtaaagaattgtgcagagacagatggaaatattaaaatatttatcctaaataaatgtttgagttaaacggtaatatcctgtgctgctctagattcaattctatcaataagctattttgagattctgacctcagtttcttgtcttcttttaagttatctctgggccctaaagagacacagctatgaaactggagaatgactgcagaataaccaaaagaagttatccaacagaatttataagatataggatttcgtttcaagagagaaaacaggagtaaaaatataaattttgggattgtccacattagagagaaaaatcatatcttcatatgaagaaatatagaatttcttcaaaaaagaaaatataagggaaggagattggaatattaaagaaaatctcagagaacatccacaactgaattccaaaaacagaggaagaattatcatgaatggcaaaagatatataacaatatacgaatgaagagaatatatccactagagaattataagagaaaggaaatcaatttaggtgaagaaagtctaagaggaaggggataaaggtgactaaatttggtgataaaaaattgaggtaggcaaaataatggcctccaaagattcccacattctaattcttgaaattagtgtttatgttatgctaaatgacaagggagaattaaggttgcagatggacttaaggttgataatcaactcactttaaaaatagagagactgttctgaattatccaaatgggacaaatgtaatcgtaagggtcctttatatgtgaaagaatgtgaaagagggcagcagaagagtcatcagactggttcaaggtgagaaaggcttggttggctagctttgaagatggaaggtttcagaagccaaaagatgcaggctgactctagaggttggaaaagcaagggaatgaatttactagaaaggaacagagacctgctgacactttgattttagctcagtgagatccaatttggacttctgagaaaataagttttacagaactgtaagttacagaactgtaggaaaataagttggtgttgttttaatccactgagttgtaccaatttgttacagtagcaataggaaacaaacatagaagctcattgtttgcgtagatacgcagtgtcagtacaaaggacaaagacctattaacagagttacaaatgagcaatggaagtagcaggtgttgcccatattttcagcagattaggcagtggaataagagaataggataaaaatatctgagaaattgttaattggggaaaaattcaaatacatctaattaaatagaaatagcattgttcaagacagaagctctattatattagctccttctttgcaactaagcagaatatttcttgagaagattatatgagcataattgtcaaaccaagcaaatgaaaatctcccaaactaatggatgtaataagtgagatctagaaactcacagaaagctgtttcatttaccataaagaataatgaaaagtctttcatctctaaattgtatgaagtgagaaattctgccaattataaatgagatgaaaacgaatacttaagaaaaattctggcaacttcataaaaaatgccaattttacatattagaagaaaaaacatattatgctgttgacatgttaagtgcatcaatagagataatgaatatgaatatgctaaatcaaggcatataaaaaatagaagactaggatattctcaaaaaattcagtttatatagaaagccagcctggttttttacaaaggtttgtataaagaagtacagaaatatttaagggtagaagaaaaataagcagccatatgctactctaaatagtgctgagttatatgggccacttttatgcaaaatgaattctattgtaaaacacaaaaataatgaaaaaaaattgtctctatgttgatttgacagaacttacggttaaagctaatgatgcagttttagaataaattttcctaaatctaggtagagaaactcaattgtcaaatgaatgatctagacccgatgacctactgggttccttctaaagtaatggccccaggtatcctagtgcttgagaaatacgtaagcattgcttgaaaagagcatgctggggcccaaggtttggtaagcgctttatgaagttttgctgcttgccttctcagaccctttagcacataaatttctaagaaaatacttctaaatgaatcattttccctgataggtcttttgataacagaaaaggtttttgcccgtggatctcaaaatacttgtgtttaacacattaaactgttagccataaatcaatttagagtcctaaaacaataatgaaaaataagtcagaatcattttgacatactgctttctaaatatacatttttcacagaccctttgtgttataatcaactggtaacttcattcttctacttcctaagattgtacattcaccacttggatggtgtagttatgagcactcaattatttttttatctgaggaagtcttccttgagctgttagttcagatctctgggcactgacatctcctgttcatttcatattcttgattgtcacgttacttttttttttttgaggtggaatctggctctgttgcctaggctggagtgcagtggcgcaatctcagctcactgcaaactccacctcccaggttcaagcagttctcctgcctcagcgtccctagtagctgggattcagacgcacaccaccacgcctggctaatttttgtatttttagtagagatgaggcttcgccatgttggccaggctggtctcaaactcctgacatcaggtgatccacccgcgtcggcctcccgaagtgctgggattacaggcatgagccaccatgcctgacctgtcaagttactttctatacacttggtgacgctttggtcttttctgttaaatcactctcagattcccgaagtgtttttcttatttaggaatagcaatactgttaattagctaagcatccgtgatgccattcactttttatggcttatctcaaccctttcaacaactttgtgctagaggtcaatttaaccgttttgccacagagaaaacaaaaggctaagaaccccatagcttatacatggtagagtcaacattcgaacccacctttgcttttcttcaaagctggtcttaagggtaatgcccaattttcttgccctctctattccctatcgtaaattccaccctcaaaccacctacaatttcagacatatttccattgtttgaccctaggtggacaagagaagagagatattacttaagagactagaagtcaaggactagattttactaggtaatcaccaaacctcacaccagagctaagagtttctgaactcactcatgcccccgggtgctgcgtgactctgaaactcaatgtcaggccttatgaagtgatcatgagctccctttggaagcagccacctctaccatttcctctttcccatctgcttctccatgaggctcttcgcttccttgagaaacttggcttcacacctatgagtaattctctgtctcctttttaaccgtacaccttcaatcaacagcccttctgtttctcttgccacagatctccacagaggcctgaaaaagtgatttatctgagcaaaggaggtcttctttattcagtgccattgctcccagatgttttcttctgattctagaaggcagatttatgtcgttcctgttacctcagcccatgaagctcaggtaaccacaggcaccttctggccgtactgtattaaaattatattctcctgatttacatacattaggtttatgagctattggaagcacctaataactttgggcaagatgatcctgactttatttttttattttagattcagggggtacatgtgcaggttggttacctgggcatattgcatgatgctgaggtttggggtatgaatgaccaggcactgagtaaagtaccagtaggtagttttccaacctttcccttcctccctccctccactctctggtagtccccagactttttttatgtgacaatatcatttttatttttctaacaaatctttcttcctttttttcttttgaagataaacatggatttaataagaatcagataattccacttagaatcatctattgggggggctattttaaaatgctggtgtctgatttaattgctttggagaggacctgagtataaatattatttttaaaagcacccccggtgattccagtgtgcatctgggaatgagaacccttgttgtcggcagcacttctcaggttcatattcttaagtggggcaaccacacatgctagtttgccttaagtgagtcctggtgtaattattcacagtacttcctgctattctcagaatctccactttgggtgataaattatatggctaccctattcatgaaaatcatctgggaagctcattaaaaattcagattatctaatctcaggtcagaagattgagtttctgtaggtctggggtaaggtttgagtctgcattaaaaactagtaaaattgtcatgagttgattctaatgcaggtgatgtacacactccaactctttttaaaatagattatttcttttggaacagttttagtttcacagaaaagttgagggaaaatacagagatctcctatgggctccctgcccctgaatacccacaggctggctgactgtgagagtctcacaccagagtggcagatttattacaattgatgaagctacactgaggcatcattatcactcaaagtctatggtttacattagggttcagtcttggtgttgtgtgttctatgaattttggcaaatgtataatgacatgtatccaccatcgctgtatcggaaaaatgtttcagtgccctaaagatcctctgttctctgcctattcatttctttctctcccctaatgactggaaaccactgatctttttacagtcttcatagttttgccttttccagaatatcatatagttggaatcatacagtatgtagccttttcagattggcttctttcactgagtaatacacatttaagtgtcctccacgtcctttcacggattcttagctaatttttttctgaatgttcatgtagtttatcctttcactgaatgaagaacaactttatttcttccaagttttggcaattatgaataaagctgctataaacatatatgtggagtttatctagtggacatagttttttaacaaagttgggtaaatcccaaagcgcacaattactatattctatggtaagaacatatttagttttgtaaggagctgccaaactctctttcaaagtggctgaaccgttttccattcccaccattgacaaatgagaattcctattgctctacctcctcaccagctttcgatgttgtcactgttttgtacatttgccattttaatagatccctaatggtatctcctttttgttttaatttgtaatttcctaatgacatatgatgttaagcatcttcccatacgcttatttgctatctgtatatcttttttagtgatagttttaaagtaaggtgttttgtctattttttaatcaggttgttcattttctcattgttgagttttaagatatctttgtatactttgaataacagtcctgtatcaggtatgtcttttgcaaatattttcacttagtctgtggtttgtcttctcactctctcgacactgtctttttcagagtagaagtttttaattttatgaagtccagcatatcaactctttgtttcatggactgtgcctttagtgttacatctaaaaagtcattgcaacacccacggtaatttatatttttctcttgtattatcttataggagttttatggctttgcattttacatttggctcgatggtccattttaagttagtttccgtgaagggtgtaaggtctatgtccagattcatttttttgtacttgtaggtccggttgttccagggccatttgtttaaaagactatgtttctctattgtaatgcttttgctactttcaaagatcaattgaatttatttgtgcaggttgtttctcagctttctattctgttccattgatctatttgtctattatctttaaagtaaggtagtgttaggcctccaactttgttcttctccttcagtattgtcagctattctgagtcttttgcctctccatgtaaactttagaaattctctgatatccacaaaatatattgccacactgtccttttaaaacactgtttagggtctgaactttaaaaacatcggaacctataatagtgtgtgttagatattgtcaagttttccgtattctaaagaaagatactcaaaggtgaataatggatctgtaatttaaataataataaataatagttaatgaactctcacaacgttctattttctcctatttgtcctatttgatccttaaacaacatagtgaagtggttatgaattctgttgtatgaattaagaaactgagaatttgaataattttttctaaatgtgtacagttagaaagtggtagaattttgattcaaatttaggttaatgagccataatgctttattatgattgtgtaatgtcatttcccaaacactgttcactgatttaaatctcacaaaatccttctgatacagactgtaaaaggcctgctaatttagacaggtgaaacgactttaccatttatgatgttatactggtagtgtaatgaaggcagaatatgaatatagatcttttaattccctaaccaatatatgttcttctcttttacttaatgtagattaaatgacgatctgcttgttttcatttaaattttaaagacctgtgaaaaccactatacttttgtaaagaaggaaaaacaaacgttcacattttgaggtagatagaaatgtcttattacatgctttggcaactctttctgaaggttaaaacatattagaaagccccatctcttccatttctaacagtaaagccaccctgactagctccccaccttctttgtaacttatctcgtatttatcatattcaaatctgcaatcttgatgctattttcgtgatcgtaattcatgctcaacaatctgcttccattctcaactcagtgagctggcaatcaatttcttagtgctatttgagaagaaagcaaaatctaaaaatgaagctattactatattacaagtaagtactaaatctgttaggtaggggctgacagatcacattagaatgtgtgccctgaggcactgtgaggcatgagaagggacttgtgatgcatgacactattattgacctttgagttacacaatttatcagaaaggaaaaaatagtttcctttgtgtcggtaaaaaccagtaagtgagccctttagtctagatttccaggagaagcaaattggtcattgtaaaagttcactaattcggctgtttattctcccaaacagaaatgggattgttaccacctgaccagcatgcatttagcagagcagtccttagctaaatattacatcagaaaccagggtaagaagcaggctatattgtgagaactattagaagtggttggcctatcctttaattggtgtttcacactgctctgcttccctacttaccattatacatactcacacgattacaaacttaacattacaacataataaacatcacggtgctctgtcattaatagagcacttcctccaatttatgcatgatacttagctctaaacttgatttatctgatttaatccttcaaatagtctacgacctaagttttttttttttgtttgtttgtttttgagacagagactcactccgtcatctaggctggagtgcaacaatgcgatctcggctcactgcaacctccacttctttgggttcaagcaattcttgtgcctcagcctcctggatagctgggattacaggtgtgcaccaccacgcctggctaatgttttcatatttttagtagaaatggggtttcatcatgttggccaggctggcacaatcctagtagtattatgctcattgtgctgttatggaacttgaggctttgatgattaagatgagttgcccaagtttgcacagctagtaagtgccagaactgaaactcaaatctaaggggaaatgggctttatcactgtattcttaagcatttctctgcattgcagtgtatgtaaaatgaatggatagtacttgaaattagtcccggacaattaagtctatatgtgatgtattcaaaatcagttgaaagttctaggatctaatcactgccatagtgcactccaggtcatgcaacaaagcgttaccccttttttgttgttgttcatcattcttatctaaagaggattatattctgaggtctttattgcattcacagcattcctgagagccacatgctatgagaaccctctttttttctcattttaaaaaagttaactttattgggatatatatataatttacatagaataaattttaccttcttatttgttcagttttatgaattcttataaactcatgtaaacaacatgagaatcaagacaatttccataacccaaatggttcatcattaactgtaaataaactttttatttagaacagatttagagttagaaaaaagttagtagtacagcgagttctcatgtaccctccacccacccagtatattccctgttgttagcatcttgcattagtacggcattgtgatctttttctgtgccagcatttcatccaagataccatgtttacgtatagtcatcgtgtctcctcgggctcctctagtctgtgacagtttcatagactttccttggtattgataaccctgatgactttgaggactattggtcaactattttgtagaataactctcatttaggatttatctgatattttcttatgattagactggggtcatgtgtttttaggagagagactacagagataaagtgccgttctcatcacatcatatcgagaccatatgctatcaacatgacaaatcactgttgttgttgacttttattacttaactgacttagtgtttgtcagatttgtccactgtgaagttattctttcctgccttgtctgtaaaatactttttaggaggaagtcactatgtgaagcttagagtggggagttatgccctgccttgtttagtggggaacacctacacaaattatttggagtaaacagaggatttgtctatttccttcatttgtttatttatgcattaatttaatcattaatttatatcactatggactcagatattttatactttgggttataatctaatagcacattttaagtttcgttgctcatattgtgctagctacagccattagaagctctttcagttgactactgtgtccttttgacatatccccattgttgttttctgttggttagtttatttttgctttatttctagcacttgttctctgggaatacaaactatcccaggataatcttatgtattccctgtccaagctcccaaatcaaccatttctccaaggggttctagttccttttagtcgagaagccaagatctgggtgctagaggtgctcactgctaccagggtgttgttccttctatgtcccctcagatgatggagaaagagatgtatatgtgtatactagctcacgtgtgtacacatatcaaaaataattccctgtgtatcatgctaaacgtgaattgtactgataccttctactgtaattcattataacatggcttattctaagttgttctccctttcatgtttctaattcccatcccaacaatgagcgaaacctatcccttgctagctgccattgatttacttacttgctcagttcttgtatacatgtatatgggttcctgaattgtttacttgtatccccatgggaaacaactttcccaactagagtgcgtacgcgcagttcattttgcctttggttttatagcctctgtgtatttacaaaattaattagggccatatatgctgaccttttatgagaaaatattcaaatcagcataaaaaataaagttttatttagtgtatagctacattgtgaacagttttaaaattctagagttacttacaatcatggatgtgtattcatgtaataatagttttaagtctatggtgttcattggatagtctaatattatagcagttatttttcaattaatttttaaagcttttatgtttttggttttctggtctttccatttcatgcatcattaaaaggagaattctgtaaaacaaaacattttatataaagatgaaatatggaaaatatttcctataagctgtctgtattattatgtattttaatggacttaaaaatgtataaaaatatgtttaaatatttgtaactacactccatatatcaattaagaaattggctgcaaatatgtgactttaaggtacgtcttttagaataaataattgtctacattcttggtaataaaatagtattattctgaaaatactaagcaaatgtggctttttatcacctgaaatagaaaaccttgacaatttcaatgctttctcctgctagatgaatcttatgagatcctataactcacccaaactttaaaaagcaatctcatctcaaactattctttccaaagttctcttttggaagttcaagggtatgttttaaaaaataattaagtaaccatgtaaattgagaacaaaatagatgagctgctgtgttttctgtataagtcatgctggatgcaaggttaggattttaagttccataaaatcaattatatacacaagctgaaatagtatctgagactaaggtaaatagaatgagcagggcatcaaggatacagcagtcaaaaacagcaaacctttcactgaatatcagatataaaacatttaggaacctgccttgaagaaatcttcttttgattaaaatttaatgatttatatttataaaatgagtagctctgaggttttatatattcataacgtcaagagtttctcagatacttcaagtacattcaagcttttgtaatgaagattcattttaaattaatgatttattactttcagcaacattttaaagtagtttgtagtatgatgttgggctccaaagaaaaacaattgcctgaagaactgtatcaggtaaaccttctctgtaacagacttcaaaagaaaatggctgagacaaactgggatgctggaaaactgcaggtgtacttttcaggatataagcattaatacgtgtgtaatactgtaatttctttaaaagtgtaatttggggcatggttaaaccacagaggtgtctatgaatttgattttgactcccaactgcagtggcagtagtgtgtgcctttctcttccagagcaataagcattttgctgaggaacttaaaatttgcatctaggaaattgaatctcctaggctagtctttgatcacacaaatctaaactaaagacggacacagtacaaaacaaaaacaaaaacagaacaagtggttcagcctcaatcttcatttttttctgtgtatgattacgagcgaagtagaggtacatcacaacaccacaatcatttattgaatagtgtacattaccccaacatccttattcataatgactttaagatttaataaagggaattagaggaatatacaaacgtatatgacagttaggtacttcacctctaaaaaaaaacaataaaaagtgtgtattcaagggagggagaaaagacatttctttaaggggactgggaacactttgggcatttgttgaatgcccataatattactttaaaaatgcccctcctattcaacatagtattgggagttctggccggggcaatcagacaagagaaagaaataaaggaagagaggaagtcaaattgtctctgtttgcagatgacatgattgtatatttagaaaactccaacatctcagtccaaaatctccttaagctgataagcaacttcagcaaagtctcaggacacaaaatcaatgtgcaaaaatcacaagcttttctatacacaaataacagacaaacagagagccaaaccatgagtgaattcccattcacaattgctactaagagaataaaatacctaggaatacaacttacaaggaatgtgaaggacctcttcaaggaaaactgcaaaccactgctctaggaaatagagaggacacaaacaaataacaaaaaattccatgctcatagataggaagaatcaatattgtgaaaatgatcatactgctcaaagtaatttatagattcaatgctatccccatcaagctaccagtgactttcttcacagaattagaaaaaaccgctttaaatttcatatggaaccaaagagcctgcatagccaagacaatcctaagcaaaaagaataaagctggaggcattaagatccctgatttcaaactatactacaaggctatggtaaccaaaacagcatggtactggtaccaaaacagatacatagaccaatggaacagaacagaggccacagatacaataccactcatctacaaccatctgatctttgacaaacccgacacaaacaagcaatgggaaaaggattccctatttaactttgttgttgggaaaactggttagccatatgcagaaaactgaaactggaccccttccttacactttatacaaaaattaactcaagatggattaaatacttaaacataacacgtaaaaccataaaaatcctagaagaaaacctaggcaataccattcaggacataggtgtggggaaatacttcatgtctaaaacaccaaaagcaatggcaacaaaagccaaaataggcaaatgggatctaattaaactaaagagcttctgcacagcaaaagaaactatcttcagactaaataggcaacctacagaatgggagaaaatttttgcaatctgtccatctgacaaagcgctaatatccagaatctacaaagaacttaaacaaatttacaagaaaacaacaaacaatcccatcaaaaagtggacagaggatatgaacagacacgccataaaaaaggatgagttcatgtcctttgaagggacatggatgaagctggaagccatcatgctcagcaaactaacacaagaacagaaaaaccaaacaccacgttctcactcgtaagtgggagctgaacaatgagaacacatggacacagggcggggaacatcacacgccggcgcctgtcggggtgttttgggggctaggggagggacagcattacaagaaatacctaatgtaggtgatgggttgatgggtgcagcaaaccagcatggcatgtgcataactatgtaacaaactgcacgttctgcacatgtaccacagaacttaaagtataataaacaagaaaaaagaaaaaaatacaattaatttcaggatatgattttaatgaatagcaactagtaacagaggttttaaacatgacaaagggagaattttcctggggaaacatttcatacccaaactctatcttcccctttaaacatgtcaaaggggaagatacagaatgtataaaagaaaagtgccagatattttcacagagcagcactaaatctataattgtaagaaatataaggaaaataataggtgataaagctaaaaataaacattaagaacatactactgaaggccatacatgccagggtgaataatgtgtatttaatatggaaggaacaaaaacattggatttttgtagtctagaaaattaatatagaaatattgtgtataaaatgataaagggaaaagcaagatgtatggatatcaagattgactataataagagaaaaaacaggaattaaactagtttgttaaaattataatgaagggaatggtaagctaaatattttgttactgtgagcaatataatttggaaacataaatatagaaatacaaaatcaaagatgatacagaaattctgattgctaatgcatgggagaacgagcacacccttaacataaaaaagaagataagttggcttctagaaatatgactagggatgggtgcaggagggcatgttctatttttgaacattagaggtcctcaccccaccccccaatattttactatttttattaatcctatagtgcacatattggacataaatcatgttcctcacttatgatgatatctctgggataggttcctagagataaaatcatgctttcaaagactttctttccctacgcattgtcatattctttaccaaaatagttgtatcatcttcagcaatatatgagggagtattgctaactatattctcattaaacttgataattaacatgtctcttgagttttaccagttttagtaaaaatgaaattttgttaatttcatttgaatttctttgtttacaagtggaatcaaatgttaaaataggttatttagattttatattttcctttctggaaattgtttatccaggtattttaccatatatattcacctgccatttgtttctataggccttattgagtttttctttctaactaattgaaaagaatatatctgtttgttgacttttaaatgaatatttgctgcaagttttcattaatttttatttgcttttttcttttcttttcttttttttttttttttttttttttgagacagagtcttgctgtgtcgccaccctggagtgcagtggcgcgaccttggctcactgcagcctctgcctcctgggttcaagcgattttcctgcctcagcctcccgagtagctgggactacagtcacgcaccaccacgtccagctaatttttatatttttagtagagatccgatttccccatgttggtcaggctggtctcgatctcttgacctcatgatccgccctccttggcctcccaaattgctaaaaattacaggtgtgagccaccgcatccggcctttatttgctttataattgtgttcatagttttaatgtatacatatatatatatatgtagttttgaagtgtccaagggaatctgaaggaaaatgcatttttttaaactggctgacatacaggaaggaagacatccttcaaagaaactgcttcaaagcaattacacagggaggaggttttataaaatttgggaggatgagccactctgaggaaaagcagaagaaatcctgagaatgaaaaacagcaaattttatgcattctggcatgcacattttcagcaaataggatgtttttggtgtgaggaagaccaaaagaatctcataacttcctttaggaaggttatgatcactcacttctcagggataaatgacattttccagctggggtcaatcaggagtggggaaaatgtcatgggaatagagggatctaaaatcattcagaaaaaaaatcttacagaagtcaagtcaaaccaaactatcttttcctttatcgtttccagtattctctatctgggaaatctcccggctcaagttaatatctgtatatacattttttctttttttacgactcacatgtggcacattttttagaataggatgcatggagttggtcataagtgacttttcaaataggtgaccaacagatttgtggtaggtagaataataagtacactatcttcccaaaattttcttcttcatcttcagaacctataaatatgtgattttcatatcaaaaagaacctgcaaaatgttgactcaggatacagaccttgagagagatcatctgaatgggaccagtctaatcatatgagttcttaaaagcaaagaaaatgtcccagctggatcaagagaagagaaacaagaagaacttgacctactgttgctggttttgaagatggaagaaggaaccatgttccaagcaatgtgctagatgttgggaacagccctcagctgacagccagccaaataattgggacctctgtcctattgtaagatactgaattctgccaataattcaaataagctaggaaatttattttcccctagactttccaaaaaggagcagagccttgcagacaccttgattttagccctgtgagaactgtgttagaggtctaacctacagaactgtgagagaataaatttgttttgttttaaggggttaactttttggtaatttattccagcagcaatggaaatccaatacggcatacaacattattttttgaataatcttttcatttttaatgggtttaatgtctaccatttattaaagtcttttatctattatggctgtcctggagaatcaaggaacctgggggttagaagagatatgagtgacctggaaagtagatagaaaactgaattagattgtttcaagaagtacagggaattaatgagcagggtgttatagtgagcacctgtagtcctggctactcagtgggctgagccaggaggataacttgagcccaggattttgaggctgtagtgagctatgatcatataatttagtcagtattgaggaagtagaggttacactctaaattatacagtgaaatgaaaggtgatgacatgtaagttgagaaggagtctgagttctggaaggagtaagtttgggggcatggaaaaatcagagcaatcaccaaaacaggaaagatataagattcagaaagaagataaaataattgatagtgaggaaaaaattatatagtatttacttttcttttgagactttatcttctgtttcccttctgttctttctgccttccttctcatcctactttccactgtagaattttgtcttgaattttgatccatggcaatctataaaagaaaacactaataacgttcttaaattcagagagaatttttcctatctctgagagcagttgtaaagcgtgaatttgtctccaaagtggtttgcattctttctataaggatgctaaatgtaaacaaagtactgctattagaatgatatatgtgaggctccccatgcaccttggcagaaaaatgttatataaatggaaagtgtcgcatatattttaaaagaatgcatgagtttattcctcaaggggagttgctaatttatgtactgtgcttgttctaaaggtacgtgcatgattcataagttagtttataagtaattttgtactggagaaagagagctaagaggatacttaactgtttccaagtatctgaaagacttattttatgataatcaactattcaccattttattgtagagaagaaggaaatcaatttaaatttcacctgtaaaagtttgtgcaaaatataaatcttatgtaagcatcctgatttgttgtggactttaagaatacaaaataaatactctttttattttgttttctaattcttatgcccctaaattctctgttcttcatatccacactcctgaattttaccaaatagttttaaaaacattaaccattcccctgctgtaaatttttcctcttgttagtctttttttaaatctaaaaaaaaagacaattagttttattttataagccatctatacctctatcatggctacctaatatctggggttaaatatgtaccatgttcagacagtacgggcataaatacacacagtgtccaacggaacaaaatagagaactcaaaaataaattcacgcatttacagtcaattcatttttgacaagggtaccaagaacatgcactggagaaagcatagtctctttgataaatggtgctgggaagcctggatatccgcacgcagaataataaaattagacccttatgtctcacagtatacaaaaactaaatcaaaatggattagatttaatctaagacatcaaactataaaactactaggaaaaagactggggaaacattccaggacgttggtctaggcaaagatttcttgaggaagatctcaaaaacggagggaaccaaagcaaaaactgacaggtggaatcacatcaagttaaaaagcttctgtacagaaaaagaaatcatcaagaaagtgagagacaacccacagaataggaaaaaatatttgcaaactacccatctgacaagcgattaataaacagaatatatagggagtttaaacaactcaatatgaaaaaataataataatccaatttaaaagggacaaaagatctaaatagacatttagatcaaaagaagacatacaaatggccaagagacatataagaaatggtcaacatcactaatcataagggaaatgcaaattgaagctacagtgatatattgtctcacagcagttacgatggcttttatccaaaagacaggcaattgtgaatgctggcgaggatgtgaagaaaggggaaccctcatacactgttggtgagaatgtaaattagtatagccatatggagagtagtgtggaggttcctcgaaaaactaaaaatgaagttaccacatgatcctgcaatctcactgctaggtatatatccaaaataatggaaatcaatttatggaagggatttctgcacacttgtgtttattgcaacactattcacaatagctaagatatagaatccacctaagtatccatcaacagatgaatggataaagaaaatgtggttcatatatacaatagagtatattcagccattataaaaaaatgaaatcctgtcatttgcaacaacatgttaagcgaaataagccaggcacagaaagataaatatcacatgttttcatgtgggagcaaaaaaaaaaactgatctcatggaggtagggagtagaatgatggttaccagaagtttggaagggtcgggcagagagggtgataaagagacagttaatgtgtacaaaaagacaattagatatttgggataaaatttagtatttggtagcataatagaggataattatcaagaatttgttgtatatttcaaaataactaagagtggaattaggatgtctctaacacaaaaaaagataaatgcttgaggtgatgaataccccaactacctcgatttgatcatcactcattgtatgcttgttcatacatgttatactttgatacatagaactagtatgatacgtacaactagtatgtatcaaactcatgtatacatactcattgtatgcatcaaaatataacatgtaccctataaatatttccaactattgtatatccataataattaaaaataaaagttaaagaaaatatatatgtaccatgctcatgaaagtttgaataaatcacaaagttacttgaaagtaacaccttatatgtgtgtatatctctgtaatattttaagtaacagacttttaaaatattatttgtagagctaattctaatgggcatgagatgagttgtttttattttttgctttttgttttgttttggttcaaaactatcaacttttccttaaaaaggcaaaaggtttagactttttaaagaaacttgtataatacctagattatttttgagagtctcattcttgtcatactttcatgattctcattcctgcttttttcttctgacacaattaaaaaatactaagaaaagtattctctccaagaaggaaggccattattttttattccaaagtaatgatctccttcatgccctcttcactctgcccttgcagtcattagtttaatacgcaaatagaagtgagctgcctaggcatattgcaagagttaatgaccaactaattgttaccaacaccacaatcccctcccatgaaaatacagatactgtgaattgatgactagaatctccatatgtttaatgggaaaataacaggaggctccgttgtactagtgacaaaacatgagggaaaaaataattttcatcacgtgcccctgatttaaaattgcttcaggccatccttgtttcacagctaggagtataataaattaagaaaaagtagtatagggctgagatgaaaccctgtgggatatgtgagtgaactaacaggtagagaaattgaagggaaaaagaaaaaaacgtggatagccttgggtggataatacaagaagcaagaaaatagtgtcaagatgcagcagtaataagctaataacttacagatgtaatatacgttgctacaggtctctcaacttcatgtgtttcatactttaagagtttctgtgaccaagtagaggcttgataaagctgaactttatctattaataaaaaatacatgccactcattagggggcagttcatagtgcagcagaaggcatggtggggactaagaatgagaaagggaagcaagagacaagcaacatttactgagagccaagcattaggcatgtgatactcatttataatctactgttttgcctataaggtaaaatgtatgatttttcattacaggtaaggaaacgagtttggatatatatatatttttccctaaactttgttgacacatttgttcattcatccatttaacaaacgcttatatttaggtaagacttcttgaaaaaaaaatcaaattctgaaataagacaaaaatgtaaatgatttttttcaatatcaggtatggatataagctcatccaaatattaggtaatgtatagtaaatcatttttttcattaaatataggcccatacgtagtgaattgacatattaaattgtaaatgttgctgggcatggtggctcatgtctgtaatttcagcactttggttggctgagggaggtggatcacctgaggtcaggagtttgagaccagcctggccaacatagtgaaaccccatctgtacaaaaaataaaaaaattagccaggcatggtggcacatgcctttaatcccagctactctggaggctgaggtaggagaatctcttgaacccaggaggcagaggttgcagtgagccgagactgtgcctctgcactccagcctggacaacagagtgagattctgtctcaaaaaaaaaaaaaaaatgtaaatgtttgtttggtaaacgtatgcataactgactagtggtaagcatagaagataacggtttattcccctgttggatgttaatcaggtccatatttaacccatcattcttatcctaacatacctttattaaatagtctagaaaaacccatctcttcaaatattttcagaaccagttttaacatcttcttttcttattagtcatgaattgaataatatttttgagacattttatatttgcaagagaagtaaaaatgagtacaaagacaaataagccacaataagacaaatagccacaataagacaataagccacaataagacaaacacctttcccctgtgttcttgatagggaaaactgatacttatgcaactactaaccgcaaataaagagtagagttaagaggaaggtagaagcagtggagacaaaattgttataatacaaatttgacttgagatgaatcttgacagacgaaaaggttttcactaggcaaatagcaatttggaagggctttctcaaaagagacaaaaagtattataggtgacagagggagcacttaaactagatctgcttggctcctagacacatatttttttccatcatgctttgttctttttcatcctttgtggaagactttaatttctagtaatcatctttagcctctctggtcatgacatcccttatctaataaacaaagtcattatgctgaagatatataacatatttatgataactaaagtttcttcttattatgatatccattaattacacagtaataataattagcttttggttattaccttaagaacattaaaaaataatgcaaatacattcctaatgcacattttcttgtatttatgtatagatacacaatagaaaacccatttcttgtgacttgtaagtttgaatcagtttcttccccccctcaaaaaaaattcagtatgtataatagatgatgttcagttttaaatcattgtgccttttgaatttagttcaggtctaaaactagtagaaatagatacttatgttaataaaaaaattgttgttaaagggtggcatatcttctgcgtctctttacgcacccatcaaacctattctttttttaatctcttaaatttaaatctgtatattgggagactgatttatttttgtgaaggaacaaaagacagaggatggcagcaccatactgattttgccttgtttatgaaatgtcaccatgttacatgttgttcaccatcttatctagctatgaggtggttaggaagaatgatgtattaggttcatattaaattaacaacatgtcaagtttcttacttctatactcttggagcaacacttactttttcctcttgacacatatcaaaaatcttaattttccattcattatatggctatttggttaagagctgcctccctcaggaagactattgagtttcttcaggatagaagaatgactgaatgaccggcatgattatgcatacaaagagtgtttgaataaataaacaaattaataaatggatgactaataaatatattaaaatatcaagacatatgtgtatatataatttaaaatcaaaaaacaaaatatttgtaagtaattcagtctcttgtgttatctctctcactctatgtcccatggcattacatgacatgttttattttatattataaggtaaatgttctggagacttttagaagcccatcattttttttctatgcattctgttatttcagacaaaatgttaagtgttgacatttctcttacaagagatagttattaaaatctaaattctaaacactcctgttaaacttttaacatcaacctaattgcactgtcaatggtatatgtcttcctttaatcttactgagtctgttctttgcgcctggataccaattatcaatttgttttggccttcacgcatgctcttcctttctgaatgaatcaagactcacaacttcctaatattcaaaatacattgaggattttccaaatactttacttaattgttcactcattctatctttcatttgttcaacaccattataaaacacccaaaaagttgtttgtgatgttgtcctgaacattgtcaaggttctacagataaattagatacaatccttggtttatgaaacttataaactcgtagttacaataaagtaatcaaatatataataaaattaaaatggagtttctaaattatcaaattagtaggatatacttgcatgttttaattataataccattttcttctacaaatattgtactatatgtacatttcatatagctaatatgtaagtgtgaatgaaatgatacacttctaactttaaatttcctggggagatttgaatacacaatcaaagctctccaaaagcatcaaaatgagatgataatttttgtattgcttttaatgtaccttttatctttagtgtattaaatattttttgtgtctgtcaatgcacatctgtaacatcattttcaatggatggtcacatcatagacgttttaaagcaacccttgtctgttggaaattaatttccttttcaatttctcattattacaaaaaaaatactgtgattgacaatctagacaatgaagatattttaaaacatctaatctaaagtaatttatccaacaaatattggttgttcgcctactatgtgtacattctcctataaagctttgaagagttaaatctctttatactctctcttccttcaccctttccctctctgtctatccttatcccctgctctgtctatctctatctgtatttgtctgtctgtctatgtcagtgtctgtaatattgtggtgtagggacttgtaacatatatggaataagacaaatatttaggaaatggtggttgaatatgtctacatatcagtattttccctattttctttccttgcttccttccctccttccttattccttctttcttttgtatttttctttgcctttcttctatatttttcttaagtattttcattagtgttgttgctttaaatgtatattacacttataataaaattagttttcaaaattaggaaaagctcagatcttctgatgctttttaaatagaggaggagacagaacgtgcacataacacatttgtttactatgaatttgtaacatccatattccctacttttttagtggcttacaaattatactatttttaattaaaatttttaattaaaatgatagaatacctcccaagaacaatgttagactgaattctgacttcatgattatgttttgagatttttgatcattagataattttacaatttaaaatctagttaactaaattctcaggctgggcgtggtggctcaggcctgcaatctcagcactttgggaagccgaggtggtcagatcacttgaggtcaagagttcgagaacagcctggccaacatggtgaaacctcgcctctactgaaaatacaaaaattagtcgagcgtggtggtgggcgcctgtaatcccagctacttgggaggctgaggcaggagaatcacttgaactcaggaggtgcaggttgcaatgagccgagatcgtgccactgcactccatccatcctggatgacaaagtatccttcctgcctccctccctcccttccttccttcttttcttccttccttccttccgttcttccttccttccgtccctctttccttattccttctttccttattttctttgcctttcttctatatttttcttttgtattttcgtttttgttgttgctttaaatgtatattacacttataataaaattagttttcaaaattaggaaaagctcagatcttctgatgctttttggacaaaattggagacagaattgcacgtaacacatttgtttactttgaatttgttacatccaaattctgctaaaagactggagatattgtgtctatacatttggaagccaaatatgagatagcagagagtggtgaaatcacccttgaaatgagaattataaaactggaaacaagacctagttgtatctttactggctaggggatcttgggctgcttcagttagtgaaaagaacaccagtttggcatcacaatgcctgacttaacctgctggccccaatatatattcgttgtgtgacactagacaccatttaagtttgcttatcttcaatttcctcagtataaaagaagaaaaaatgattattatgttcataccgttaagttaaagttatataatatgtgtcacactgcaaataaagtatattaattatgtgcataaacccacttattactcactaaacaataaaaaaactaccaaaaaactaacgtttttattgcataaatataaatataaccttaagatttactgtgatcttgtacaagtgtatataaaatcaaacactagacatctcttttagagagttttatttttcagtgtctgtgcttatcttaaatgagtactatttagattataatttaagcagtatggatgtcagtggttgaagttcatttcattttatacattacataatgtgtcattaataggaagcacttattcttaactatgatttttcttgtctcttacgagaactcagaatttgaaaacctgtgaaagtaatctaaatattcttcccattgcaggaggcttttgtgcattactgctgggtgatggtctttcattgattctatgaacttgccaagcataggaattctgtttactgtttttctgcccaatatggtagtaaatcactccaagagttggtaaaatgactgcatattgggaagttctgtaccatcagttttttcagcaatcatctgagggatcaaaacagatctgattcaccagagactaccttaaaaaaccagaatggcagttgatttaaaattgaagatatatgtggcctaagatgcagaactatttgtcttcacagggcataaaccttctagtgggaaaatccattccatttatcaaattataggccagaagtttattttgcgagcaaagggatttgagggttttaaggggtatttctatgttctctagcaaagagagctcctttactctgaggatatttcttcctaaagaagtaggactcagtttctaagatctgtgcagtctttcccactatataatctgatacaaaaacgttactaatgtttgaatgtttcttaattgttgctacaagtttgctttttacatgaccatatttattagcctgttcacaggctgctaataaagacatatccgagactgggtaatttataaaggaaagaggttcaatggactcacagttccacatggctgggggaggcctcacaatcatggcagaagaggaaggaagaacaaaaggacatcttacaagagagtgtgtgcaggagatctgccctttataaaaccatcagatctcatgagacttattcactatcacaagaacagcatgggaaagacctgccccccatgattcaattacctcccaccgggtactcccactacacttgggaattatgggatctaccattcaagatgagatttgggtggggacacagccaaccatatcactacatgaatacactgaaacccacccaatccacccaatttatttccactacactacatcaaaagagatagtgtacaaaaggatgctggtttttgtggcctgccaaatttgaggcaaaatcatgacagtggttcatctgaccaccgtcttcttttcttggtaatgtactgaaacttcttaattctcaaaactaagagtaatttctgtaaatgagaaactgaaaatattacttgaaagagtttcaaggaagttggattctattcccagtttcatcgctgaggagcatatcactttagctttttgagtcctagttttcacttctgtaaaatgagaagacagagtgggttgaattctaaaatcagttgtagggctaagatgatgacttaccatgctacagtttggggtagtttcttattgatatgaataatattttgtgcattatttacattaaaaatttttattgttttcagaaccaaatgacctttttctctaaaaaaatacatatttttagatatttcttgctttatgggtcacaaaatgtagccacaataatcagaaaaggaccaatattgttgacaaagtgaacaactaagaaatgtaatacttgagccccagagctggcttttaacttaaatagtaaatttctaaattttgattactataaataatattatcactataattatcttccacaacagggaagaccacagtggctctgaagaactaaataaaacctagatatcacacatatttgagagaacaaaaattcacaataggaagctgtacaatatttgggaattcttttcacagtttaaactttctctgtcttcaaatatccctattacagcaaaatcccacctactcacaattgtacgtattcaaaatgggacctcagaacacaagcaggtggaaatcacaggtcatggccacagttgaaatgatatgtctttgctaatttaaaaacacactcttgtgatgagcagttttgcatatttaatataaatattacatcaaaaatagattgtgcttgctctgcaatgttgcccttataagccctggagggatgtgatcattttctgctgactctgctatatatgacggtttgtaaattaatactaaccttctcaatggtaaatgttggcccagccctacagtaattatgtaacgcagaaaacttgagcaatcagacatgtttcaatggtaaatattttgtctctccccacccccggtattatgtattaacgaatacattattacctgctcaagcattttctcttttctgtctcaatcagtattatggtccgtgatataattaaatgtttcattttgaacaaaaacatttattttattgctcaccaaggctgttcaattttagcctttggccatatgactttaatcagaagtatttgtgatttagagcactatagcatgtttatttttgcaatttattttaacagcccatgggaaaatgacagtaaatagcttgtaatttttgtaagtaataaaaaaatagctgtgacctatgattgaaggaaaaaaaaattcagggactttcctgtagaaatagactgtcatcgtttgaaaactcaacattttctaaattactatttatttttaatgatcaaaggcttcttacacattgtctcttccagtgattctcaaagtgttatacttagactactgcatgataataaattggaaaatgtctttaaaaaatagatttctttgccagacgcagtggctcacacctgtaattcaagcactttgagaggacgaggcaggagaatcacttgcgctcaggaattcgagaccagcctgggcaacaatatgagaccctgtctctgcaaaaaatacaaaaattagccaagcgtgctggcacatgcctatagtcctagctacttgagaggctgagacaggaggattgcttgagcccaggagacagaggttgcagagagctatgattgcaccactgcaccccagcctgagcaaaagagcaagaccctgtctccaataatagtagtagtaataataataatgatggatttgttggcactacccagaattattgaataagaaaattttgtgagcagaatctcaggctctgcattttgtataagcttaccagctaattcttttgaatatttaagtttgcattatcctattttaaaattctattttttcatataaactgcaatcatgagaaaatataggactttttccccaatctcacaagttaactgcagaatttgaatgagaattcagatctctttattcctaagacaatttctagagacaatacatactggatttcaatttatttttcatcctacacagttggtataaaattaattttataaataagaaccttttatattactaggataaaagtagcattctaacaatttttcatctttaggttggtgtctcacctacttatgtaaactttttctagcttaatcagtctaatatatcattctttttttttctgagacaaagttctaaactcatgacatccgatcacgtgttcccgtctcaaaattacttgttttgctctcatttgtgtatttcccatttgtattaatcaagatatactaggttatgctgcattaacaaatgaacatgccaaagtcacagtggcatagtgcagtcagtgaaagtttatttttcagccatactacatatccagcatggctcagcagggatctctgctccattctgatgctattagtgctattaagcaaatattactggtccggccccctctgacacatggtaaaattacacatgcatgctttttttgcaattacattgggcaattaattagttcttccagatatcctgtaagcagaagttgcaggcattgcactgcaacatttaattgctggtgtgagaacctccagacatcatctctctggcattacaattggtaacattgaaaatggtaactattccttcagtgtgcatctttgaggtaccataaggagcagagatttgcctcagattcacaagagatatattgtacaagagaaaaataaagttgtgttgttttgtcttctgagattgttagaattgtttgttaccttcgcataacattgactatctggactcagatatcctcagaaatatatatacagagagatccagcatggaagaggctgtgcttccttgtatctgcaatattttaaacatgtggcgtttttgtccccatgacatagaaaatgtctgaaaaagtttacacagctttttcattcctcaagctaacaataataggatatttttcctcacagcccgttatccagaactaatcacatgactccaacatactaaaagaagggtaataaatgcaatttttaattttgggagaggaaaagaagaacttgatattaataaaaactagtaatggggtagacttcattgaataaactttatatttttgttcatagaaaattttccctcatatataatttggaagtcaagaacaaatttgttgacttgggataatatcaagaagtcataatggaatatgcagatatatgtgcctgtaataaaataaagtcctaaaaagaaaaaataataaatagatttttaaagcatggtaaatatatttgcatattatgacagaggtcaacacccttactctattaaaaatatttacaaatcaatgtttaaataatggaaacgtaatcatataaaaccaggaaaaaaagtgaatagtcactcaaatcgtaatatgaatacccaaatctagtaaacctctgaaaaaaatgttcactgttattcttctcaaaaaatgaaaatttaaaaatcaagtatatattctgcctaccaattgtcaaaaacattttgaaatatattaatagcaagaggcagacttgaagggagcaaacttccctagaacatctataagtagttaggggatcaattttaaaacgtttatgaaaattaaaaatagaaaatatatcccagggaaacattcaaaaagtatacaaagatatatatttgagaatattcactgtagcagcattttcaaaactaaaaatttagaaatgtttgtaaataggagatagttcagtaaatcatggtacagaaagacagtggaattctgttacagatagaaagcaaaataaacacaggactttcagttaggagcatgttgggtatatgtgagaaaaaaatgtcagtgaggtcatgacatacttggctagagagagaaaaatgagaggttcggtgatgaaggttaaatcatagatggtttgtaggccaacataagaacttagagcttcactcaaatttgagcctttttgatgaatttgaccaaaagagtaaaattacttggatgaccacttgtaaggatctctctacctattttgtggtgaattgattaaaatgaaaataatataagcagggagaccaggtagatgactatttcctgaagcaaaataagagatgttggtaacttgggataggataatagtaatgaaaaatatggaataattttaaggttaaaaaattaagatttgctgatggactagatacagtgagtgagagaaggaaaggtattaaaaagtaatccaagtctaccttgatcaagtgaaaggctgcattgaaaagacagaaagaagtaggtttatgagaaaatcaaaaatttacttcggagcatattaaagttgagttgcctattttgcatcaaatggagatgtaaatgaagcagttgggtatacaaacgtgagtgaagagatacattttagaagcatcagtgcataaattttattaaaggctttttaaagtaatgaccttgaaagatcatctatagtgagtaagtagacagagacagaaggcatctatggatcaagtcctggagtaatccaataggtagagcttgcaagatgaggcagagctagctagtaatagagaaaagaagtaatttttgagattcaaaaaaaaaaaaaaaaatgaaagagtggcatccagaagccaagtgaaggtatttaaagggggattttaatcaactctatcaaatacaatttatagtcaaataagatggctgaaaattgacaacatgagttggcagtatgactattattggtagcatttgtatgaacgtctcatgatggaaaatgaaagtctaattgaaatgactttgagacaatggaagaaaaggacacaaaaagagtgagacgattttctgtatgcaagcagaggctgaatagtagacagcagggtatatgagatgaaggtaggtttttatatgatagatattatagcttgcttatatgctgatgacaaaaatccagtaaagtaggaaaattaaggttacataaaatagaaaaaatagtaaccaggagagggtgagacaagggctcttgtttgtttatttcaactgaggagtcaaatttctttcatttttaagaataagtacagcattgtacttcaagagcaaaaaataaagagcaaggtaccatggtgaagaaaggtggggcaggagggggaaagaaggtgaaagataatttataccattttttgctaataatttttatattatctaatttagtctttatttttactttttgaacagaattttttaaaaacagttttagagtgacagaaaaattgggcagaaagtacagagaatttttgtatgcttcccgctcccacacacatagcatcttcctctatcaatattttgcaccagagtgacacattttttacaattaaaaacctacattaacacgtcaatgttactcaaagtctatagcttacattagggtacactcttggtgtcatacattctatgggttttgacaaatgtataatggcatgtatctataaataaatttttattatcaaagtatcataaataataactatgataaaaatattttatcataaagtatcataaataataattttattaccctaaaaatcctctgtgctctagtcatccctccatccccacccaatgcctgaaaaccattgattgtcttattgtcctgcaattttttctataattttattgtggtataataaacaacataaaattcgctttcttaacaattttaagtttacagttcggtggtattaaatatactcataatgttgtgcaacattcaccaccgttcatctctataattcttttcctcttttaaaacttaaattctgttatacacactaaacaataattttctatgcactcatcctgaagcccctcaccaacactattctaatttctgtctctatgattttgactgctatcagtatacttcttataagcaaaacctatagtatcattctttatatgactggattatttcacatagcaaaatgcccttaagatgtatccaagttttagcatgtatcagaattttctccttttttaaatgctaaataacattccattatacccatacatcacattttctttgggtttaggtatatctctcatagacagaccatgtgtttttaactattctgtcaatctctgtttttacattccatttacatttaaagtaattactgaaacgaggaggggcttctgtgtttttgctctttgttttctatatacgttatagctgttttgttcctcatttccagaattattgtcttacattgtgtttagctgatttcttacagcgaaatatttaaaatcctttcttatttccttttatgtatattatatccctattttccttgtggttaccatgggaattacatttaacggcctaaagttataacactctcattttgtttatgccgacttaagtaacataggaaaccctttaccacttaatggccctgttgccactccttttggttgttgatgtgacaaaattacatctttatacatccggtgccccaaaacataaactgataattcttttaaatacattggtctcttaaaatatgtggaaaacaaaatgttgtgttacaaaccaaagttacaattattctagcttttagattaataactgtttatttttaaatgtagtagtctcttaaatcatgtagaaaacaaaaagtaaagttacaacttactgttgtaagtaaagttacaaattattgttgttacaataatactagcttttgtaattgcccatgtatttacctttatagaggtatttatctcttcacatgactttgaattactgtctactctcctttcatttcaccctatggaacccacttaagcatatcttgcaaagtaggtctagtggaaacaaattccctcagattttatctgggaatctcagtttcaccctcacttttgaaggatggttttgtcagatttagaattcttcgctaacaatttgaaaatattttttcagcacattaagtatcttggtccactaacttctgccctacaaagtttctgatgagaaataagtggataatgttactgaggattccttgtgtataagtcacttctctgttgctacttgaaagattttctccttgtttttggcttttaaaagtttgattttaatgtgtctatgtgtgggtctctttatttttattctctttgaagtttgagattcttggatacttacattcatatgagaagttttcagcaattatttcttcaaataatttctctttctgtctctcttgctcgctcactcactctctctgtcttctgggacttctacaatgcatatgttaatttatttgttggtttcccagatatcatttaggttctgttcatatttattcaatatttttgttcctgtttttcagaatcaatatttattgttgtatcttcaagtttgctgattttttcttttgcttacacaaatttgcctttgaatccctctgtaaattttccatttcaaatactgtacttttcagctccagaactttaggttcagaatttctttttttctatctctttattgataattacattttgctgttaggtagttttcttgactttatctatatcttcctttagttctatatcttccttaacatctttaagatggacattttgaagttttgtctatggatctgccatcaagtctttttgggtatagtgtcggttgatttttttttcctttgaaaggccatgctttcttgtttctttgtgtgttttgtgttgttgtaaaaaatggatacttgaatctaataatgtggtaaccctggtaatctgacccttcccccttcctcagagtttgtcagtttttgatattctttttatttatcgttttgctttttgtattgttgtaggctatctctcattctgggatcagcctgaggtaaaataataaattcttgtcaagtcttttctgaatctatgccttttccttaacatgcacagtcactttttaatgttccccaatatatacaattgcttttaaatatatcagtgtttaatgcctggctctcaaaagagaaaaaagaaaaaaaaattaaaaaattagttggagaagcactggaaagtcacttcagccagaggtaaaggggctttcaacaatggcgagacgtgaaaaatcaatggcagctcgtggcttgtctgcacctctctgataagaagcagctgtcagaagaacaaccccaaatatctggaggacagagtcctttgtgctcaccctggctccttacagttctgtccagtctgcttcaggaacatatgcatagctgtctaccacagcgatgtatgcggagaatgggtagcaggtgctgtactgagtgctaaacttgatggaagttaactgcaattttccatcccagcattcccctggaagttgcaaactttcaatagactccagggttccaaagagttacatcagacagattctgccagtgctattgttatctaggtggggagacagattcctggtgcttcctacgccaccactttttcagaatcctctggaatgaactcctttgcagaagcaaagaagttggtctttgttgagactacagacaaataatccataatagtagtactggttatagagtgtatgggttacagttactgacaaattttgagaagttgttattgatgctaatggagtactcttctacctgattctatttcctcagtaaaatgagaagcagttttttagctgaggatgagaagagggtttgaaacagaaagaaaaacagagattgaaaaaggagttgaggatttatgcaaatgagaaattatattgttgaaccttggaacagcaaaagtcactaggatcaatagataataggtcctgtgaggttgaaagatcactgaagctggatagataagaaacgaagactgaaaaatggaatacttgaaattaagattatgaagcagatgcagttattgacagtaaaacatctaggttatggtcatgagagtgggtgactaagacagcatgggaggcaaaattatgaaaggacagaaggaccaggaaatgagacaacaggattctaaaatggctgcacatatttttaaaatcaccaagaattataacagaagttggggttgagagagtaacagtaggcccatgtgctataaccctcaacaatgtggaagagaaaacccaagggggtgccactgagtaaaacaaggaagggaggcagttgtagaatgtgatgacatgagctacaaaagggcatttgtagggagctgcaagaaatcatggcctgaaaggagcattgaaaagcaaagagactatattccacgttcaggaccagggaatgggagaaaaaaattcacaacttagagagggtcacaggcaaagccacgtcttcggggaagagctattattcaatcacagctaagtcgttagagggatgttcagaaaaacaaacaaacaaaaaacagaaaatatgagctaacttattggaactatgaattctacagggcagagcaagaacagaacagctttaggagtcaaggagagtgggaggtggggtcagactgaggttgtcagtgccatatggggaaaagggccctgcaacaactaacataaacagagatgtgggacatgattacatgagctctgatagtctgtgagacagagtgtggtagactggcaaatgtgtgttggaggggagggatggtggtgttactaggagcacacaatgatctggactgtcctcttttcactcttctctaggtttgtgaggaagctttggaaagggacagaatcagaactgtgggcatatccataccagaatattagcagtaaatatcccggcatggtggcattatgcatgacactgattttctcattttttatttagtatttttaagtacaattgtcctgctgtgtcagtagtgggttcttcatccatggattcaaccaaccgtgaatagaaaacattcggaaaaataatgccactgtactgaacacgtaccacacttttaaaattcctgtaattttctaaccaatacagtgtaacaactatttacataaaatctacattgtatcaggcgttataagtaatctagagaagacttaaagtatatggaagattgtttgtagtttatatgcaaatactacgctcttttatgtaagggacttgaacatccatggactctggtatctgtgggggtcctggaatcaatccctcacagatatctgtatttattttaagtgaatgtgtattatggaatataaatataaatatatgtatatgcacacacacacatatatatacacaatatatacacacatatatatacacaatataagtgtatatatatgtgtgtgtgttgtcatttttcaacttaagtttaaaaaattgcctagaagggataaaacaaaaatagagctccagatatctaatgttcttttcagaaagaaatctttatatctctgttttacttcagctgtattttttaaactacttggctaaagtaaacccacgttcatagagaaaatcactattattttgcataaagttgtgaagtctaaggctgaatagagtctaacaatcatatttattgatgtgtctgttgttaaacactgagcagatgtctccattagagcctctataatgatgtctagatcattttagggagatttttactaatttcaagctacatagtgattccttccacatcaaatttttacttcttagatatttcttgtatttcttatcccctaatatggagactattaggctctcattatttctttcccactcctcagggttatcaggaggattataagcatgagctctggaattagacttctagtgtttgaatcccattgatgtctaaaagatatggcctttgccctcataatttgcaatgtaatcattgaagagaggcaggtacatcagtttctacaacacaatgtagacagaagtaagtatcataaaaataatattggctgaattggtagaaaatatcatggagggaatggcttttgagtggggattgaataaacagagtgttttaggaataaaaatggtgttaggaagaaaagttcaagcaaagaataattttagtgaaggtataaaaatgatgaactgctctcatcttcaggggagggtctagaaggatgggagtaaatattgagtaggggaaaattgagagatgtggttaaaaataccttgtttggacatgaatactagcctaataattctgatttgctttactatccatttgactttatggatcattaaaaaattttagtataaatgctgatcgctggtatatatctctctaagcttgtttctgcacatgagagcaatcaggaaaacattttcaatcaatcacttattttactagctggtgccaggcaaatggctttcctgattttttttcaatctttaaaattgacttaacgactatttttttaagttaattgggtggttcagggtaagtttaaatgcaaacaaaacacttagcataggagagcgagtgcgtaaattcacagtgggagcaaacatcagggcaacaaaaaaattagagccatttttgagtcattgaccacccacatttgagagttttttcctggatgaacattccttctgcctttggaaataaattaatgttttagagcaggggttagcacactttttccatagagaaccagatagtaaatattttgggccttgctggataaatagtctctgtcacaggacttgtctctacttttatagggtgaaaacacctgtagacaatgtgtaaatgagtgggcatggttgtcttccatctaaacattatttacatagtgggtagtagatcatatctgagccacagtcatagctggctgaccctgtcttagaaaattattgggaacaggtgtgtaaaaagttgaagtaaacaaatgcaatattaagatactatcacataatgatgaatgttcaccaaatgttttctttgaatatcaatgcaaacctggcctgactttgatagtgatacttccaactaagggcggaatccatagtcagcaaaaattattattttttgtatgtcttttgctgttacagagcagaggaaacaattaattcaacttagattaaagaaaggcatagtttaataataaatagacctcacagaaacacaagcccagaaactaacatagagctgggtatcatgagatataaaaatgggagtaaaaatttaggacagtaccaggtacttatttcagcccatgggcaatcttatttttcttttagaaaaaaatcttttaaggctgggtagttggcttatgtctataatcccaaggcgggaggattgcttgaacccagtggttatcagcctgggcaacatggtgagaccttgtctccacaaaaatataaaaaattagctgcgtgtggtggtgcatgcctgcagttccagctactgggaagactgaggtgggaggattgcttgagcttgggagtcaaggctgcaatgagccatgatcgcaccactgcactccagcctaggcaacagagtgagaccctgtctcaaaacaaaacaaaacaaaaagaaaaaccctgtaagattaatgttgatattatccccatcttacaaataagaaaactgagtcacagaccactgctaaagaagtttctcttggccacagcttagaaaatattagagccagattttttatccagccagttcacctcaggagccagtaatcttagacgttgaccaactggtttaagtcaatttgctctttgaagtttgagctaaactgtgaaaacaactaggatttatctaatcatagtagctaacatctgtgaatcaatatatgccagggctttatacaaatcagctcctttaatcttcacaaccctacttaatggacgaaaaaaagagacactgtcaccgaaagtgatataaatgcaattggtagagccaggactctatcctggtgagtctgcccttagagagtataaacttaatctttagggcaagcaaaataatgttaaaaaacataatatatgatgtgcagagaccaggctgctgaaatcagcaagagactgatttgctaggcaaggtggttcccagattatggaaccagtgaaggaggataattttttaatataggaagcaactgagaaccactgtagagttgtcagtcaggaaggtttgcttgatagcagtaaacactggagactgtaagggagtttgaaaaatgagggatccaaaagcaatcatgagttttgtgttatcctgcagaagagtgagagtagtaagaaactgagaagagagaattacttggagacatatttcaaaggaaaatattatttgacactgacaggtcacagaagataaagcaaaaaatagtcaagattaattcacatgcttagcctgggataccctgacaaatgatgttatcacagacaaactgaataagtttagttaaagaagccagtttgaattaaaagtaagtttggttaaattcactcgtaaatttaaagagatatgccattttggcaattacaaatctagagatggagtacagttcatagagcataaagagtgagaaaagccattcagtttagaggtgagaacaccatcagttacgtatgtctacaagagtaaattcaacagagtggtgtgaattgaaggtcatttggtggggatgaaataggttaacaatttgaaaccataacataatgagtttgcatggagtaataatgctcatgttagatttcaaggaattaataaaaacggcaaatggaaatacagttagcaggaacctagatcatgtagcacacatttcagaacctgtccataacagaaggaaactgcagtggtgactctaggacaaataggtagttttcctttcttttttaaagttggtgaagacctagtttttccttattgtatatttagttttcctcctatagctccaaggtaaaatatataagtgctatttgtttcctagcaatatttttcccagaagcagaatgataagttgtagaagagatatattttaattatttattgaaaatgtaaactgcttcaagcaatataacaccataaataaaaatggctaattttgaaagcatgagagtgtacacaagtctgataatttcaattctccatcaactcaaagaggcatcatgggagcattttatataatcttcactctccttgtcacaaattcaccctgagggaaactaatcttgatggagaagtctgactgtcttgggtagggaaaaatgcatatgtgagtattctcatgatgaaatttaaactatgattttggtgaaatatttgaaatgtaactaaaaatatagctttctccaaattgctacaatatagtttttaattatgttatctttctccttttttaaatctgtggatctattttcaagctattccaatagctaacattttcatttttaccccctactcataaggtaccactgtttgccgattatcatgtaagatttaattttattgatcattgcttataatgtgtgcctagagacagagaacaagcttccctatccaatttctattttcccttcaggttaataggtttccctttcccaatcattgagtattgcacataagaacaaggagaaaaatgtttgttgaggtatatttagaaaagaaaaagaaggaaaatcctcatttagtagtgatcttgtgtttttctctagttcattagaaaatcagccaatgtatgaagactaagctttaattaatgaagttgtcctatattataagagggttccaggatgtatcttacatgcaaatgttttcatctttttaaggtaattctattaatatacctgctgtgccctaagggtcctagtctgagtacatttatccctttagcaagatttgggggtggaggccatttgtattctcttctattcatgttggactttagttggtgattagacacagtagacaatgtcatgtagggttagatattcatgtatggcttagatgcaggtagattttacctccacaatcatatgaacattgagtgtgtctcattggatttctgtaagaatgacatgaagtgaagaatttaaacttcttgacaaattacatgacacagaaaccactccataagtgttagataatcttttgtacgtgaatgggaaataataatatatattcatattttcatgttttggcctaaaggaaatctagatattaaatactagatcctggtgggaagattatttttttttcagggtggaaactgagcagatggaggacaaggatggggaagatttttctatacttttgttatgtttttggactttaatccgtatgactgtattatatatttgaaaaggcaaatataaaagtcatctgagctttttgtcatcataatggtatcctttctgacaatcgttgcttttaatcctaaaatgtctcatcaagtgcctttgtctcacaatttatctgtagaacatatatgcttgtgtgtggaatgagggctactcagactgtgaactcagaacaggcaaaatgtaaatgctcatttaattgctgttttgtagatctaaccaatttctatgactgtgtgaaagtggttaatgaggtttttctttctctttatcagatgatagtccaccttctaagataaaccttctctgtgttgaagtcaggcttagataaggaataagttattaataatcatgaaatctaataattaatagctttattagaagactagggagaactgatttactactaatagtaattattcttaattacagctaacctttgttggagtgtacagtgcaaagcactttaaatgtattatttgatttccctagcaaccctatgtggtacatggtagacggtagatgctagattaataaaatgacaaataaccacttggaaaatttgtctaaaatcatgtggctggtaaatggtctcagagccaagcctttttaatgccaaaactttttaatccctatgctctagaccatcacactgctgtatgtaagcagctttcaattatgtagtttaagaaatttttatttagcaactatttctggagtaattagtgattgttccattttgtagggaactggggttgccaagtcgacagatattgggctcataattcatatcatgcattgacagcatgtatgcaattaaccatctcaagtggtagcactgtcacgacaaactgcctgttcagtctcatgcatttctgtagtattgtaatccaaagatagtggggtctcatagaataaaatcaaatatattatccatgatctgaactatcagatattatccatatctgaacaatccatgaaaacatttattgttttcctcaatatcactcaaaatagattttagccctcttataaagagtttaaacagcaatgataacagtaacaaaaatggctttttattttctggctaaattatactttacctatattcatggttgtttacaattaaaaatgatcattctcaatagaatgcatacacatggtcaaaagctgtatccacatattaccaaaagaaactggtgattttattttttaaaaaagtaacattcaaagtcgttttgttacaggaagaaaaaaatgtctatgaaagctggatattttacttttcatttatttttgttgtatcatgtgaagagagctggagattctctgtttcataattttaatatatggattaaattggattattcagaaaaattctacttatgacacttctctgtactgttttattacttgcagctacgtaactctaatcctaatagaacccctgttattcatgacgctatgtaagctttgttgcattattcatgtttactttatttaaatttgtgtctgtgaactgtttgatttgtgaggctctcaggaaactgtcatcaacagaaatgacaagaccaagcttgtaaattacattttttatatgtgctaaagtctagacttctatgttttgctaaagaaatcaccctattaaaaataataacatgtatccttaaagcagagtgtctatgatttataggagcaataggcttgctcggaagtggggtgcctgcagtatctttaccctgtttacttgttccaggtgcctattgacttctcacattgttgccactataacgcggatacaagctgaaactcacaattgttatgttttgaaacttgctaaggtaatgtttttctcttgccctaaatatttgaagatatatttgaatagatcagtgtcttttcacccatttttaaagcacacattgtcttgtgcttctctttttaataggatggagatgagtgagacttgttttcccatttttgacatgcttgagcaagaaaacaaagctttccaccatcccccaaatggaaaaactgcactatgctagatgggttttgaaaaataaaaacacaaatcaaaaccttctaacagcacatctgttcttctttacaggaattagacgatataagctgcagctcagaatcagaggtaagcattacatttaatctgtcatgcctgcaggtttttatgaagttcaaacattttaaaaggttcagcttgataaaactccctcattatgtttcttgaggttagtcctgtcatctttgtccagtgtctcactaacaacatttccagttcagtaagagcagacattgctcattgcattttatttgatctcaggctatttaatactataagatgttgtgtgcacaccattcctttgggattttaaaccattaggttaaaggtacatccaattatgtgatatctttaagcaacttgaaggtgcagttttatatatagaaatttaccactgaacgatactgaaatgaagttaaggttgtgaaacacactgacaaaagatagggaatccaaagttaggaatgacattttgtccttcccttgtgctatactgaaaatgaaggaagttgagttgagtacaagataaactcaaggacactgaggattttactttttaaaatgtccttatagatgcatcatacacaaggtaacaataatagctgtacttatggaatagccgggagtttaaaacaccctttcactgatacgattgtactggaaccttaaaacagtcctattcacataagaaatcggtgattttagtctgttttccccaatgagaacacagagaatctacaagtaattataattttttttttacaattgcaaaagcagtaagaaatgtagcagcatgtcagagcctgttcttcagacatcaaggttggtactgtctgtactacacagtctcactgctgcctataagtatatatgcgtgcacctatcaacacacttatgtacaaacacacataccagtggatagtgagaggaagaacaaaagaaccagagaccaagtaatatgtatttgctggataaattaagctgttctctctttcatgcaattcaattcaaactgctttaaacattaaaagaaatgtattggctgatgaaaacataaaagtccagagtcactgttcttgtgagtttcctagatttgtcctcaagtgtgccagatttactgtgggcatgccttgtgcttgcaaaaggtcaatggcagtttcgggaaatctgtgacccagagttcacagcataaatcctgagtttccaataggttgaaatagccatgaaaccatcctgtagccaagcgtaaagcacatagacttggattagcttcagtggtcatcatggtaagggggaatggaatatcctgtttgcattgaacagatatacttccccattatagagaaattgtctatctcatatgactacaaggatgttctgcaatggggaatagtatattaattctatgcacacaacctcaatatgtactataactctgttttagtatgtaactactctgtgctaggtatgtagaattctcattatttgactttaggtataaagggatacataagtgtactcctaaatatgtgtaagatcatacttatgttctgataaataaatccatcaattcatttttatttcattcagtttaatttttatttgtacacattttcatgtatggggtacctgtgaatttttatttgtacacattgtcgtgtggggttcatgtgaattttcttacatgtgtatagtgtgtagtaaacaagtcagaatatttagggcgtccatcgtctgaatacattttgttaactataatctaccctgctatcaaacattgaatcaatcccatctaactgcatgtttataccctttaactcatttctctttatactcccccttcccccaactcactcctcccaatctctattatctttctttccactctctacctccatgtgatcaaatattttcactccagcatataagtgagaacatacaatatttgcctttttgtgcctggcttagttcactaaagataatgacctccagttccatcaatgttatgtcaaatggcatgttttctttctttttatggacaaatagtattccattgtgtatataccacattttctttaaacattcattcactgatggacacttatctttgttatctacctttgttattataaatagtgccataataaacatgcaaatacaggtattcctgtggtatactgatttcctttgggtagatatcagtaataggattgctggatcaaatgatagttccatttttagtgttttgaggtatttccatcctgttttgtatagtggtttactagtttacatacctaccaactgtgtatgggtgctcccttttctctgcatccttgccaacattcattattttttgtctttataataatggccactttgattggggtaagatgatacctccttgtggttttgatttgaatttatctgattagtgacactgagaatttttcatataactcttggccatgggcatgtcttcttttgagaaatatgtattcatgtcctttgcacactttttttcttttttcttttttgagacagaatttctttcttgttgcccaggctggagtgcaatggcgcgatcttggctcactgcatcctctgcctcccaggttcaagcgtttctcctgtctcagtctcctgagtagctgagattacaggcacatgccgccacacccagctaatttttgtatttttagtagagatgggtttcatctttttttttctgtcgagttgcttgatttccctgtatattctggatattggtctgctgtcatgtgtttagtttgcaaagattttctcccattcaataggtttcttcacactgttcattatttcttttgttgtgcagaagctctttagtttaagtctcatttgtccatttttgtttttgttgtctctgctttggaaatcttagtcataaattctttgcctagaccaatgcccaagagagatttccctaggttttcttccagtatttttatagttttgggtcttacatttaagtttttaatccatttttgttgatttttgtatatggttagagatagggatctagtttctttcttctgcatgtggctatccagttctcccagcaccatttattcaagaaggtgtccttcccccaatataaattcttgtcagctttgttcaagatcagttggctgtaaatatgtgactgtgtttctgggttctctattttgttccagtgggatatatgtctatttttaaaccaataccatgtgttttggttagtatagctttgtaatatattttaaagtcaggtaatgtgatgccttcagcattgttccttttgttcaggattacttggttatgcaggcttttatttcactctatatgaattttagaactttgtacaaaaattctgtgaagaatgatggtattttgatagggattgcataatctgtggtttttttgggaaatatggtcattttcgtgatattcttctgatctttgaggatgggattttttcatttttgttctcttctatttatttaatcaatgttttgtaattttccttgtagagatcttaaatttagtcctaggggctttaatttttatagctattataaaagtcattggcttcctgatttctttttcagatagatgactattggtatatagaaatgctactttttttttttttttttttttttttttgagaagaactctcgctctgtcacctaggctggagtgcagtggcgcgatctcggctcactgcaagctccacctcctgggttcccgccattctcctgcctcagcctcccgagtagctgggactacaggtgcccgccaccacgcccggctaattttttgtatttttagtagagacagggtttcaccatgtttgcaaggatggtctagatctcctgacctcaggatccacccgcctcggcctcccaaagtgctgggattacaggtgtgagccaccacgtccggccgaaatgctactgatttctgtatattgattttgtattctgcaaacttactgaatccatttatcaaatctaagagctttttggtagagttgttaggttgttctcaataaaagatcatattattagcaaagaggaacaatttgaattcttcttttccaatttggattccttttacttatttttcttgcctgattggctaggacttctaatactacgttgaataggcatggtgaaagtgggcacccttatcttgttccatttgttagaggaaaggctttcaacgtttcccattcagtttgatgttagctgtgggtttgtcatatatggcctttattattgtgaggtgtttttttctatgtttagtttttgagagtttttatcctgaaggattgttgaattttatcaaatgcttgctctttgtctattgagattatcatatttttttcttcattctgttgatgtgatgtattacatttattgatttgcatatgttgaaccatccttgcatccctgggataaatctcactcaattgtgttatcttatctttttaatatgttgttggattttgtttgcttatattttgttgaggaatttttgtgcatgttcatcagtaatattagtctatagttttcttttgttgttgctgtgtctttgtctggttttaatatcagggtgatgctgctctcatagaatgagttagagggattccctcctcttcaagggggaattttttggaatagtttcaggaagattggtattaattctttgtaaatttggtggaatttggcagtgaaaccatctggtgctgggattttctttgttagaagattgtttattcctaattcaaccctgctacttgttattggtctgttcaggttttctgtttcttctcgattctatcttggtaggttgtgtatttccaatactttatctatttcctctcggttttccagtttgccaaagtatagttgttcataatagtctctgatgatctctttatttctgtagcatcagctgtaatgtctcctttatcatttctgattttgtttatttgagccctctctcagctttattagtttagctagcagtttatctattttgtctatcttttcaaagaatccacttatcattttgttgattcttttaaaaatatttatttcttataaataagttttattttctattcagtgggtacatgtacaggtttgttacataggtatattgcatgatgctgaagtttggggtacgattgatcccataactcaggtagtgagcatactactcaacaatgtgtttttcagccttctctctcccccttcatccctccctctagtagtctccagtatctatttttgtcatctttgtgccctgagtatccagtgtttagctcccacttatagtgagagcatgcagcatttggttttctgtttccatgttaactcacttaggataatggcctccagctgcatctgtgatactgcaaatgacatgattttattctttgtgatggctgtgtagtgtttcatggtgtatatgcataccatttcatttatccagttcaccattgatgggcacctaagttgagtccatgtctttgctattgtgattagtgttgcaataaacatgtgaatgcatgtgtcttattagtaaaatgattcattttcttttggaaatatacccagtaatagaatgggtggccaaatggtaattctgttttaagttctttgataaatctccaaactgctttccataatagctgacctaattgacattcccaccaaaaatgtctaagcattcccttttttctgcagccttgccagcacctgttgttttctgacctttaaataatagccattctgactggtgtgagatgttatcttattgtggttttaatttgcatttttcttatgattagtgttactgaacatattttcatatgtttgtttgcttcttatatgtcttcttttgaggagtgtgttttcatgtctttagtgctatgtgcctacttcaaaatgttagatctcaaaataacatatctgaatgtctaaatttcttgccaaacttgggctattttcatctattattttgttaaattgattttataattcttttattttctcttcattctgagaggtaccaataattcaaatatttggtcactttatgtcataccaaatcacaaaggatttcctcattcttttttattctttctgccttatttttttgtctagctggattatttcagaagaactgtcttcaagttctgaaattctttctgctcttaatctagtctactgttgaagtttttgattttttatatatattttttattttttttattttttatttattaatttttttttttgagatggagtctcactctgacacccaggctggagttcagtggcccaatctcagctcactgcaacctccatctcccgggttctagcaattctcctgcctcagcctcctgagtagctgggattacaagcacgcgccaccacacccagctaattttcgtatttttagtagggatggggtttcgccatattgcccaggctggtctcgaactcctgacctcaagtgatccatctgcctcggcctcccaaagtgctgggattacaggtgtgagcccctgcacccaacctatattttgtatttctttcaatgaattcttcaattccatatttttatttggttcttttcaaaaatatctatctctttagtgaatttctcattaatattatgaacggattttctgatttcttcacataatttttcagatttttttttctcactgagcttatttaaaatcagcattgtgattttttaatttggagtttgaaaaatttatttttgattaaagtgtattgctaaagaattattgtttatttagaattgtcatatttccttgctttttcatgtttcctatttgcttatgttgatatctgcacatcagatgtatcagtcacctttttctatttttgaatttactttgtagaggagtactttttttctgtattcatggtacggtgagtaggacaccttggctttgattctggctatgtgcaatactgtagtctctgtatgatttctttggcagtaaacagtgttacttctacctgtgatttcctcttaagttgtgattattagtggaggctgtggtgaagttgtgctagggactgggatgttaggtaggtcagtcttcaggcctcagtggtaacaaaggtgggttgagcatgccccaatgccattagcattgtaccccaaggcagtttacactagcccccatgttggcgattactggagagccaaatttcgagcctatgtgtggcttgcttgaatgctggtagtggcaggcagtggtggatcaggtaggtgggtgggttctcaggccactgggcagccagtgtgccatgggcagtggctcattcacagctcacaatctattctaagtagtgacactgtgagtttccctaacacctcactccaagcactgctaagccccaggacactgtgcagtcatccaagtgctaggtaagaaaatggtgccttgctctagccacttagatgtcagaaagggtgtaggacccagcatgagcgccctccctgggttagcttcattctacgatcccctgacagcttcttgtgttagtttcagggcttagagggctagagggactttcccatggctaagattggatgattccactgtgggaatataagctgctagaagcctctcacttacccattctagcatggagaactcactcctggctcccacccaattcctgcccctagacaaccccagccaagcaggctgcctttcttctttctctttccttgcttttcatattttctctcacttttttaagagaaaagagagagttttctctcttgaataatgtgttttaattgtgcttatccgtatactatttcagttcttctaagtagaagtgagcctaaaatgcttctagtcagccatcttgaagcctttcctcaaggcagtttttaaaaattcagtttatttctacttttcagtttccattatccttactctaacaaagccaaattttaatgcattggatagatatcttttattgatgtgtgtttcatagatttgttttattgttttgtgtgcaaaatagtggttgcctaagtcgtattgtgttatctaaagaaacaaatatgttttcttggtattcctatattggcacggaaacatctagtttatttcttcctattgttgtgtggttctacagggtgagaatatactgcaatttacttaatcactttcttattaatggataacaatttggcttccagcttcccacccaccacaaatatcattgcaatatatttctgccaacatcttcttaaaaagttgtatgagtatatatttggcttatacacctgaaaccagaatgagaatgagtttgaatgtgttatttacatacttgtttagatactgatgaatggctctccaaaatgtctctacactcccctctagaaatacatgaggcttgtttatcttcatcatctaccaaactcagcattattcagtggcttccaaaaactctaaatgctgaaaatacttaccaatttgtatgttttataaaggggtttaatacaagtaagtacttggtttaaaaaaatcagtggatgggatgcaaaagcaagtctagactgggcctctaagaattatgtcagaaaaaaataatcaaatatcttctaaagagagtttcaaccttgagaccaccatggaacttttgagcttaacaacatatgatgcagctgctaagttaaggaaactacaactagaaaggagctctcactatcactacagatacaaatacgtcttggtatctcctaagtgacactcagaatgctggagaatcaatcatcactgcaggagtagctcagatctctggactgatttctgctagcagaaaatagcaaaaaaggcaagaagaaggtctttgtcattttctatttaccaattttatgagcattcacctaacatacaatttgtttctagaatcttagctgcaaaggagtatggggaaaataggggttttctggcctctataatgcaaaaaagcacattaaaaccatgtatgaaaaggattttgaaagagccaattcatagcatccaccatgccaactttctaatggttggcagtctaatgtgtgaaaatgactttgtgccttctgtctattctttttagaactgggatttccatttctataaaatacatattttttaaactttctggttgtaatcttgattatttttgttggtttgattacagattctagataatagacaccttgccattttgtacaatagaaatattcctcataacattttatgcctgttgacataattttttaatttacagaaatacttatttagtgtgataaaatgtgttattgttccacagatatcctgtaatttgagttttgtttaacaaggcctttcttattcctaggccgtaaggatgaattgtcttttaataaatttataaatgtaataatgttttaaaaaattaatgcccttaatttatctaaaaaccattgtgtgtattttgataggtagagatatccttatccttgttttccccttttaagtaagctggtttttcagcaccatttacctaacaattattcattctccgttaaattgttttacacctttattgaatctcacgttcctgaatgtgtgcatgtgtgtgtatacatgagtgcacatgtgtttggggtgtttattttgatcctttaatgtatcttttgcattacatcaatgtcatccttttttttattattatactttaagttttagggtacatgtgcacaatgtgcaggttagttacatgtgtatacatgtgccatgatggtgtgctgcacccattaactcgtcatttagcattaggtatatctcctaaagctatccctcccccctccccccaccccacaacagtccccagagtgtggtgttccccttcctgtgtccttgtgttctcattgttcagttcccacctatgagtgagaatatgcggtgtttggttttttgttcttaaaatagtttactgagaatgatgatttccaatttcatccatgtccctacaaaggacatgaactcttcattttttatggctgcatagtattccatggtgtatatgtgccacattttcttaatccagtctatcgttgttggacatttgggttggttccaagtctttgctattgtgaataacgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttctgttgccattgcttttggtgttttagacatgaagtccttgcccatgcctatgtcctgaattaccatgcctagtttttcttctagggtttttatggttttaggtctaacgtttaagtctttaatccaacttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcattatttctgagtgctctgttctgtttcattggcctatatctctgttttggtaccagtaccatgctgttttggttactgtagccttgtagtatagtttgaagtcaggtagcatgatgcctccagctttgttcttttggcttaggattgacttggctatgtgggctctttttggttccatatgaactttaaagtagttttttccaattctgtgaagaaagtcattggtagcttgatggggatggcattgaatctataaattaccttgggcaatatggccattgtcacgatattgattcttcctacccatgagcatggaatgttcttccatttgtttgtatcctcttttatttcattgagcagtggtttgtagttctccttgaagaggtccttcacatcccttgtaagttggattcctaggtactttattctctttgaagcaattgtgaatgggagttcactcatgattaatgataaaggggatatcaccaccaatcccacagaaatacgaactaccatcagagaatactacaaacacctctatgcaaatgaactagaacatctagaagaaatggataaattccttgacacatacaccatcccaagactaaatcaggaagaagttgaatctctgaatagaccgataacaggctctgaaattgtggcaataatcaatagcttaccaaccaaaaagagtccaggaccagatggattcacagccaaattctaccaaaggtacaaagaggagctggtaccattccttctgaaacattccaatcaatagaaaaagagggaatactccctaactcattttatgaggccagcatcatcctgataccaaagccgggcagagacacaaccaaaaaagagaattttagaccaatatccttatgaacattgatgcaaaaatcctcaatgaaatactggcaaagcgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcagtaaattaggtattgatgggacctatctcaaaataataagagctatctatgacaaacccacagccaatatcatactgaatgggcaaaaactggaagcattccgtttgaaaactggcacaagacagggatgccctctctcaccactcctattcaacatagtgttggaagttctggccagggcaattaggcaggagatggaaataaagggtattcaattaggaaaagaggaagccaaattgtccctgtttgcagatgacatgattgtatatctagaaaaccccattgtctcagcccaaaatctccttaagctgataagcaagttcaggaaagtctcaggatacaaaatcagtgtacaaaaatcacaagcattcttgtacaccaataacagacaaacagagagtcatccttttttttattcctttgggttcacagaatactctaggctatatctcctccttttgtatttctttttcaaatttgagaacaatcattgatctgtattttccatataatttttcagttatttttattgatatcttcataacactaatcagagattttggctgagattgcattacatttataggggattatgtaaataattggcatatttacatgtcatttcattaaatatctctatattaaacaacaaagtctctgtcctccattagttaaaaatattatccgtgatattcttaactattagattggttgattcctaaatagtaggttgaaccatatgaatatatcatttttattatttataaaagggttggttattgttaaattcacatggttaaacttagtactttgtagttttattgttataatcaattatatatttcacttttatatttatttttggtgctgagaacaactattaatttgtataaattaatgatggtttatgcagccatgtctaatactttgttggttgtattgctatctttttctgaaataggtattatatcatctgccaataataacagtattatcactttccttccaatacttaacacctcattcctctttcttttcctacagaattgatcaggttatagggtatttagcatgcatgccaataaagaatattgttatagccagcattcttttttctcattagtaaaggaaatgatcacaattgttttctacttaccatacatttctgttatataagcttcactacattcagaaatttttttttagattttataggttgctgacagattattatgtttttgtcccaaatgtttaaagaaagatttatttgaatattgaatattgaaattattttttacaggaatctattactataatgaattatactaatggattctctaatgtttatcatctgtggatacaagtcatccaggtacagcttatatttcaagcaagccttccttgcagctaattagagttatatgactaaatatgggaaatagaatgatagtaaagttattgtgagtgacttacaggttatctccaactcaacacacaacagtggccctggacattgaccatttctcccttcttgactagacatgacaataactggagtgactttagaagccataaattaagtgttgacatgtcataccatcctgaaccaatcagaatctcccatgagataaaaataaacttctatctatgtaagtccctgaaattttgttgttgttgttacctcagttaaacctttatcctatctaatgatgtctttgaagtttggtgataaaccctaattcatcagaatgcattataacttttctaaatgtactattagattagtttgaataatgctttgttgtagattttagcatttctattaataagcaaaatgtggctaaaattttactttcttatataattagtatagtcaatattttacataatcttatatagaacataattttaaaataaaaattatattagacttttaaattaatcttgacagctttttctctttatttaatttccaaaaaagaaatgtgtaaaatgcatgttctctaggctgaattatatctgccaaaaaaatgtttaattcttaaccaccgggttctataaatgtgacctattttgaaaataaggtctttgcagatgtaatcaagttaatataacgtccctagggtatgtccacatccaatgtgactagtgtccttttaagaggatgagaatggactcaaaaacacaccgatgaaaatgctgcatgaagacagatatacaaaggaagacagccatgtgataaccaagaagagattaaatttatgcagctacaagccaaggaatatcgaaggttgcaacaaccatcagaagccaagaaagatcattgccttgctgacatcttgattttggacttctagcctccagaactatgagagaatacatttctgttgttttaagccattcagtatgtggtagttaattatgtgagccctgggaaactaatacagattttggcactgggaggtaggatactgctgtaacaaatatctaaaaatgtgcaagtggctttggaattgtgtagtaaatagagtctggaagtgtttttgaagcatattctagaaaagtttagattgtcttgaagaggctgttggtagaaatctggacattaaaggtgttctggtggggtctcagatggaaatgaagatcatgttttggacaccggagaaaaggcaaccctatttataaaataattgagagtttgatgatttggaaaattctcagctattcatatttcaaagaatgggaaagcatgttctggagagaaaacaccataggtgtgtctgaataaatttttgctacagagattaagcgtgtgactcatggatccaatcaactatctcagtagaaacggtcaccttggatgaaagatgatagaaatgaacaaagggcaggaaggctgttggactttttggttccacaaacagaaaatgggcagctagagctgcttggctagcaacctctgttagccttcaagaaaaaaataagaaaatttttaagggtggctcagatgccagtgggattttcaatgtctgggagggtgggatggttaccactgtggatcaagagggcagggccactgctattgaataccagaaggggatagggagccatctcagtgggttcaatggaaagagtcacggagaattattctcagaacttagactttaatggaattttctctgataggttacagacttgcttgggatatgtgaccctttcttttttttcttttttgaatttctcccttttggaatgggaatatctattctatgcctattccaccagtgcattttgtaaaaaaggtaatttgttttctctatttcagaggtccacagataaagaggaattttgccccaaaatgaacattacccagcatctcatccatatctgattctgaagttttagaagatgagatttgggagttgttgagttacttttatttagaagacattttggtgttagaggtcacattaggatgggttaagattttgggggatgttgggatggggtgaatgtattttgtatgtgaaaagatgtgggttggggatctagcaggcatattaatatgggttgaattgtgtgcccccccacagggatacgttgatatcctaacctcaagtacctatgaatatgaccttatttggaaataaagacattacagatatagttaatatgaggtcatcagggtggacctaatctaccctgattgatgttattttaagaggcgaacagacaaatgcatatcgaggagaatgctgtgtgaggacatgaacgcacgaaaggaagatgaccatgtcacaacaggaagagtttggaattcagaagatgcaatacaagaaatatccagcaaccaccagaaggagaggcagcgtggtcttgccaagatctttcttttagacttctagctctagatctttgaaagactaaatttctcttgttttgagccacccagtaggtggtcatttattatggtatccctagtaaaaaaaaaatattctggatagtttggtaattctcatttataaaactatttatcggtgaaaccccatctctactaaaaacacaaaaaattagctgggcgtgatggcgggcgcctgtagtcccagctacttgggaggctggggcaggagaatggcatgaacccaggaggcggagcttgcagtgagctgagatagccccactgcactccagcctgggcgacagagtgagactccgcctcaaaaaaaaaaaaaaaaaaactattaatacaatgataattattactattaatttctattggtgggaggctgcttctgagatggaaaacatgtctttagctacaatttaaatttacttaattctaattagtctgttaaaatattctatttattacatatttgtaatgaatttgtcatgtcatctattttctttatatatttattagcatagtattagcatgataatggccttttttttgttcaacagtccttcctttagtttatccctctttctcctctcacaattccttagaggcagcaaggaaaaactgaggggacccttttaatactttggctacaaaattttttagctggattacccaggcctttaagcacatttttctattaatacctgtcttttatcacagcatcctacatttgagtgccacaatctgaatttggtcatctattgctgcataaataattaatcccaagcttaggctcaaacagcaaacacttattatgtcacgaaattgctagggccagacaccttactttcttgccatatggccttctccataggctgcctgagtaccctcacatagtggcagctagcttcactcaggaagagcaatccaagaagagtgagagcccagcctaatcttcaaagagttatgccatcaactcttctgtattctatggtgacgcagacctattctggtacaatgtgagagactttacaagggtctgaacacaaggaggtgggggtaatcgggagcaacttggaggttagcttccacagttattaaggcataatctccaccatacaacatgaggagtgggctttgccaagagtatcaacatacattctgctggatcttcatctaatggtcagttgaaatggacatattggaatttattataaaataataattttaaatgatttttaaatgatttgctacacagatcagttacctgtaatgaaaaactaacagacaagtgatttttaaaaattggatcagtatgaggttcacctataatatgttcacactatcctggcccctgagagtaatattataataaaactcatttttataagtgacatcatcctagtcttggtatcaaatgaggcataaatggattgaagtgctcatttggcctaataatgtagcgaggttatttcaattagaatcacccagctactagtaatctgactatgttattggagcaattcctttaaactactgaccaagtcttgcctggctcagcaggccacatctaatgtgattacctcctaacgtgttatgacatttaggaattctatacaacaatcttaacaggacatagaaataccacttctataaaatgaactgacatgaagttaattctttaacgcatttcattaagagaaaagtgtttactttcatctctgcaaacaattccctcattaatctgggaaatatcacctgagaatgctattgaagtcgataaaatcaaataaaataatgacaggtaccgacaggaatgcaacaaattctactccaaaatatactcccctattagagctgttgtaaaccatgcttggattcggctaccttggcagaagatttaaaaagaaaagacacattcacagctgtgtaattagaggagaataagaccagcaattagttgtagagtaggtgttacttctatgttagcatctattttcagttttttatgttttgctttatttcctgtttcttgctgtctataagaatttccagacaaactttgagagtctgggccatgtttaacaaaatcacagaatactgagattaggaggaagtttaacctaatgttgccaattcctgtttagacttgtttcccttcgaagcaactaatttttacctctggaatttgattttgaccctaaacttaatggaactttagtgatagaactcattgccttctgaaggagtaccttctacaaaaagttcatttgttcaattgcaaagttctttgtcatatcaagcttgtttatccacttgaagttttcatatgttgacataaactctacctttggcaatatctagcacaagtctcatttctcttcagcaaaaaagacccttaaaaatatttatgataaacccttttgtatttttgttgctaaaagtggaatcacctcataaagctgaatgatagcattactgagtctcctgagatgggcttgtcatcacatttttctttctgtgtgcctttacgacatcaagaaggtgcatgattgctgtgtatttccagctcatgagagatttggtcttgctactcattgacatggaaggttagcctcagtcaaaagagttcaatagtcttccccaggagtatacttcttgactcacagtgacacaacaggataggtgaatgaaataatcttgagagtctgtatgctagtataaaactagtgagggcagacattaaagactcataaaattaaaaatcaagagaaaggtcaaatcagatgtgaaaagtattgtttcttaaggaacttacacatccaggatgatgtcaaagcgagagacagagaataaagaggggggacctttaagtcaggaatatagcatggtatgtgatttgaagcatttactgaatgccaacgctatgagtgttcgagtagtactctggaatgttgagggaggggatcatttttaatactggaatgagaacctgggaagtagggtaccaaaacatgttgaattgattcaagattcaattaacagggatttattgatgttctatattgaggcaggcaatgtttcgggtacagaatccacagttttaggcagtgagacactcacaaacttacaatgctattaaagttgtgtggcaatacactgaacataaataagacatgatatgctgattttgaagttgtgaaagagtttgtatctggattattgattttatagtatattttgccaatagaagttataaaagtattatggtatgatttttattgtgtacattttttgtggcttaataccaatgagaagttgtatttgccagatgttatatggtttaaatacgactaaaaatcttaagttatagtttacttgctctggttggttctctttcagtttgtttgctctccctgaaattttagatatcagtgtaaggaaaaatgagtgagactgccatagaaattcagagctttttacatagtccaactcagtatagtcagggtaatggtgtcaatgagctttgtaaacaaaaattgctgtgggaaaatttctcagggactgtaatagtgagatgaagcccctaggttcatactgtggaaccaaaggcaagacactgagattaaagcattttgtaagcattaagtactaatcataagtagaaaatgatcataagtttttaaaagaaaaaaatagcatatacatagaaaaggattttttaatcaactgggcttttagatgttactagtaattgctaaataatattccagaatcgtctttataaaatcatatagtactagagttttagtttcagaaaggtgggatagacatattttccctatttcctcctgctaagtacagctaaaagccctgaatattatatataaaataaacataagaagattgaaatgtgaaaggaggaaggcaactggctaaaggccttaggacccaaacactaacataataggatgctctctgggttttctttttttactcagatcacaaacttaaagaagccagaaacccagaaataccaataggtgtagacaaacaaaacacaacaaaaaactctaaacaaaactctaatctctctagccaaaagatgaagaaaaaatatagtgagacagatagctgttagataatagctgctttactccagccaaacaccactaaaaagatcatagtcccatacccatcagcagaagccaagtggggagctagattttcctgcttacaagggtataataagatactccaataccctatcatgatggtgtcagagaaggcagagtaggaacataggtctctcactcctttcagacaataagctcccttcttccactgcaggatcaatagagacaacatatggagcctggacttccactccaatcatgcattaatgatattctcctccctgtttcaactgggtgctatcagagcagactcagtagaaagtcaggacttttaccaccaaacacacattttagaacaagaatctaagacatattttagaacttgaaaatattacaactgagacaaacaaaacctaaaactcaactctctgtgggcgagcttaagagcagaatgaagaggactaggggaaaaaaaaattagagaccttgaaggtctctgataggatcttcagagacaaaagaaattacacttctaaacaacagaaagactgcaaaaataaagcaaaaaataagaataacaaaacccaaatcctcaagaacatccgggagtataacaagggatctaacatttatgtcactggagtctcagaaaaagaggagaatgaagctataagaatattcaaagtaatgttggctaaaaagttggaaatttgaataaaaggctaaacccttcagatttaagaaactgggcaaacttcaaataggataaatccatagaaatctgcaccaagatgccttggagttaaacttctgaaaactatatcatgaaaaacaattttaaaggagataactaacactttccctacacagggaagataattttaatgacagaggttttctcatcagatccatagagactaaaaggaaatgacacaatagtttttaagtactgaaagaaaagaactgtcaacccagaattctacaaccagaaaaaaatctctcaagaaagatgaatcaagatagtctctgatcaaggaaagctaacagaatttctccccagtagatttatccaaaaagtcttaagaaagttctcaaaaagaaaaagaaatgttaaaaaaaatcttgggacattaggacagaagaacaacaaagaacaaaaacaatctgggtaaatacagaaaaattccccactcctcttgaattttgtaaatcatgtttgatgtttgaagataaaattttaacagtgtgtgctatagttctgcaaaataaaaacaaacaaaaaaagccactaccaaccaaaaccaaaacaaactaaccacaacgctgcagctgggtgtcagtaaaagtaacgttctgttgcaaccagatattaaatgtttgatctccatggtcgctttccatggatttggacaagaaaatgaaacattcttcaaaaaacattcatgttgtatacttaaaatgtaaatttttctacttaaaggtaccaacatctttggtatgggagaggacagaaaagcagaaatggagtattttattctctgaaggaggtaaattaaataagaacaaaccataaataagttgagaagtataaattaaatactaaatgatgtaattcatactcaagtgttagagaagaatagattaagacacaaacacgaaggatttgggctggactttgaaggatggaaaagacttagataaaattaaagacaatgcacagtgggagaaaggacacagaaataagcatgggcatggaagcaaccaggctgagatccttgatgtcggagtgttgtattagttttctacagctgccctaggaataaccacaaactgtataacttgaaaggacagaaatttattttctcatagttgtagagacaagatgtctgattctgaaattcgggtgttgactgacagaaccatgctcctcctgaagttctaggagatggtccttccttgtctctcccaagcttcttggcattccctggtttatggcagcataaactccagtctctgcttccatcttcacatgtctttttccctctgtgggtctctgtgtccaaatgtcctcttcttttttttttttttttttaacagatttattttatttttttttattttattattattatactttaagttttagggtacatgtgcacaacgtgcaggttttttacatatgtatacatgtgccatgttggtgtgctgcacccattaactcatcattaacattaggtatatctcctaatgctatccttccccccactcccccacaacagtccctggagtgtgatgttccccttcctgtgtccatgtgttctcattgttcagttcccacctatgagtgagaacatgcggtgtttggttttttgtccttgcgatagtttgctgagaatgatggtttccagtttcatccatgtccctaaaaaggacataaactcttcatttttatggctgcatagtattccatggtgtatatgtgccacattttcttaatccagtctatcgttgttggacatttgggttggttccaggtctttgatattgtgaatagtgccgcagtaaacatacgtgtgcatgtgtcttcacagcagcatgatttgtaatcctttgggtatatacccagtaaggggatggctgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaacaggtgtgagatgctatctcattgtggtttcgatttgcatttctctgatggccagtggtgatgagcattttttcatgtgttttttggctgcataaatgtcttcttttgagaagtgtctgttcatatccttcgtccactttttgatggagttgtttgtttttttcttgtcaattattttgagttcattgtagattctggatattagccctttgtcagatgagtaggttgcgaaaattttctcccattttgtaggttgcctgttcactctgatggtagtttcttttgctgtgcagaagctctttagtttaattagatcccatataaagagaacattagtcattggattaggggccgctctaatccagtgtgacatcatcttaatggctgtatttacagagatgctgtttccaaattagtcacagtcacaggtaccgagtgttagattttcaacatatttttcaagcactagtcatatttctcaacttgaagatgtgaaaagtagtactttaggtgggtttgaattttgtggagccttagaaactatataatatttgcatttgataaagagccatgaaactgattcaaaaccaacccaatactgtataaactctttctcactttaaatatagacacatacaaatagaggagcatttctggtagatttatagatagtaaatttgtaatagtaaatttgtaatcaaacattgataatgaaatatcacatcaaactaggaaccaggagtcttcatttctaattctgtcaccatctctactatgccccatgaccttaagatacaccttagcatgaatatgggattatttttaccatctatgatatagataaatttctcagcttcataataataaacatttttattgcatgctatatgtcaagcactaatacatatgctgaactatttacctgaattgtctcatttaatagttaaaatattcctatgagttaaatcatattatccttactttttaggtgataactaaagcccaaacagagttttgaaaactgcctcagtcaaagggtggtattaagattccaacctatatttatcttagtcaacagctaggttcatagccagtattcaatcaagggttcacaaattgtgagcccattgatgatatatggcccaaagatatatgttcttagatatacattctgttttaaaagaatgagccaacatctaaaacatcaaatgattttacattaaaataatttttataatattttgaaaaacttagtaggtcttgaacttctctgcccaaacttagctggaccttaagaacatttgcccatgcatttgcccatttagatattcatgcattctccacttaaatgtaatccccagctctccctatcacctccaaacacacagtgtgtcaattatgatttgtcattgagcttgcactattgttttcttcttacatctatagtggaacttctttttacccatatttcaaataaaagaagtggaatacttctttttacccatatttcaaataaaagtgagaaaattaacaataggctgaaatatgttatttttctcatgcctctcctagattcttcttttatgtgaacttgctggctcctataggcatgtaagtttgtaactcctgccatattgcctctggatcagtgatctcaaccttggctgtacacatgaatcacatagagagatttaaaaattcccaatgttcagtctgcactctagacctattaaatcagaatttctgtgcatggagcccaggtatcaatatttacagcatcccactgtgcagtcaatgttgagaaccactgctctagatattctttaagatatcttctgttttctaaattctaaatttacaattcaaaagccagttctaaagattggaatggttcgatatgttgtgtgtaagctgtatattggggatgtgggattgatgtagggacactgactgtggatctttgcttgccgagctaagcaaattagaccaaccctttagatgtgcagcccattctagcacacaacattgacatccagaggaaaagtgtcataagttagtcttagttatggggccaacagtttacgtgacctaagaaagtcatttactcagtctcggttttattttcttttttcaactatgactcaacagcgctcatatacaatgctgtatgcaggtcctatatttgcagtaaagacagtatcagaaaatcaaaataaagtacattcaagatatatacttactataagaacataaaataaattttttcaaacctactgatttccaacagaaattcagaaacatagggggacaactgtactgcagaaagacatgtattcagaaaggtaatcagaatgtgaaatgtttactgcaatgcttaggtaaggaacttttgcccctggctaccctccaaggtctagatgacacatgtctctggtgaatcatgaggttgctaattgtaagctttatggattcaacaaccagcactgagaagacctgcaatgatcagcagccaaagccaatggcacagcttggagcccggcgctttctgttctttgtgttcatactagttcattctctagagaaggtcagagtattccatacaaaactatgctcagttttcaagtgtgaagcttccatgacaggaaacacatcaaggcttttgacagctgataactttgtacctcctctctgaggggctcctgttcagaacaaaaatgtaatatagctccgggtgttatcagagctgttataaaatgcacttgggcattctgaggattcatgcttaatgcctttctataatttgtgcagaatgtgtgcagagtccttacagcatgctaataacattttgttatgacacagtgcagcaccacagagccaacttacataaggatagaacaatgatgtagaaggcaaagataaagattagaatttcaagttaaaaagcaaggttttatagaggccattgataggttggaggtaaagcaactgacaacaacttaaaatagttaaagacatttaggcatatcttagaatgagactcgactgacattttgaaggcaagcttataggaaaattaatcacatgaggagtgttcattgactttctatagaaaaagtattgagataaatttgcaggtattcaataaagtagagtgcctatcaaaataggcagcctgcgttaggacgtcaccattttccatacatgtgtgtgtttttcttcctaaaaatattgtctatatatgccagaaacaattgtggctgaaataaatttcttgtatcaacaggatctcagcttataactttacatctgagaatgaagccaaacagaagtacttgcttttgtttgtggcattgctcccgatttatttgaatttagtcctgtcactggagttcaataaagtcaggcagtgaatccatatggatttgggtaatagattgatgttctgataatgagaatcaatccagaattaaaattaattttaggtgaagagtaaatacactgcttttagatactcatgaaactctgcttccttcttgtaagtaatgatgagaatgacatggatatgtgaagaatagaatgcagaataaaaacagaataaatcttcatgtgtttcataaacaaaatccagggctggtggtaagtatatcaaagcatttgtgttttatctttgaaggaaatatgaaatgttacaagtttttcattaatttatgtagacactaagtaggacctgagagagaaataataattatacaaaatagtgttttattggataaatgcttttttgttaaactattgtacttgagtgagaaattatggtgtgtattttctttatattcactattgtgcattttgagatgccattatgccaacagattataggcaaacctgatgattatgctctgaactgcatccattatatttattaaaccaccttttctactaccttttatgaatgtttaactatagaaacttcaacgttttaaaaatgatttatataatcaaatcattcatgtataattaattctactaattttcatgagtgtttcaggtcattttggcataattagccattgttgagggttttctcccccatcaattaaactaattgctttccacataggtatagattgaatattgatccccatttttttcagctcacttgcataagcaaattatgcctaattgccagcttactacatcattacacacttatcatcaattatacaaaaatatactctgctagacaaatgatttctttgtggcattttgaagggctttttaattgtgatgcttagaacagtattgtcattttaaaaaatattaaacaccatgtttaaaccaataacgcaataaagcgtgttattggttaacaaacataccagctcctggctagaccatcatttaccttggaatataaagagtgtcttaaaacaatttgaaggaaactcattgttattaaatatagtaaatccaccaatgcaaatattagaataagttctttctaaattttttagcttaatctttatctttcccattccacatatttatttcttctctacctgacgaaaagtctttgagaagatctgaagaggtggtgaatttcaaagaatcactatacagaacacaccaacatttttaaaagtcaggagataaaagcaaccccattcatcatgcattctgtgcagagcattaatgtcttttagtgattttactgggcatttgtcttcactagtttctcagttagattctttaaaaagtacagaaagatatgaaaataatataatcccaagattctccttacagatttctacaccctatgacataattttcacacattagctctccatagagaatggagataaaccaaaagccaatattaaaatgtattttaaaataagtgggaggactgtcctgatatgacagtcttattttaatccttggctattccactaataaaatcatataatatgagccacttttacattggtgctcacctcatggaagccagacttttctcaacaggatgccacatttagcaaagtaggcctccacaggctgtatctaacacccacaaacaaaagctgaggatgcgaaaaggttctaaatgattctatcgcttgaaactgcctgataatgagtcttgaattacctgtggggatcttgatgatcaattctttatttacactttaggactaaccttactcttttcttattcaagaaagttggggaagacggaaagaagaagagtatagtaaatattcccttactcattgatatctttttaaaaccaaaatgggacaattttagaagaccatttcgttttaatcaatttaatgtaatttaaccattttctaaaattggatgatgattttgtgccacaaatcctaggctcagcttatggaatcacaggacatcagagttagaaaaccaatgggagatttacatagctttaatcactgacatccagtatctatttgaattcctctagtggcaggtgacttgtttttacctagaaagcagcacataatatttcaagggagcttcagtcatcacaaggttcttagacccattcatcccatctctgcactctttcaaatcttggaaagaacttatatttttctcctcacaggttatagtttgtgttgataactctcataaatgcctactcttttccattgttgaccaaacatccttagatctacattctccttgtatagtttcagacctttcaaaatctttgtctacggatatatttcatgcatatctcttttttgatggcatttaaggtctgtgaacaggaaggtagcatttatagaaatcatgaaaacaatacaaaattataaaacaaatgccaggcgcagtagctcacgcctgtaatcccagcactttgggaggccgagatggatggatcacctgaggtctggagtccacaaccagcctgaccaacatggagaaaccccgtctctactaataatacaaaattagccgggcatggtggtgcatgcctgtaatcccagctacttgggaggctgaggcaggagaattgcttgaacccgggaggcagaggttgtggtgagccgaaatcgcgccattgcactccagcctgggcaacaagagcaaaactccatctcaaaagaaaaacaaaaacagaaacaaaaaacagacaaaaatctattattttcccctttacatagcttttaaaagatacaaatacaaaaattcaccttacataaaatatacatgtattaagaatgctagtagagaataatacataaagttgtaaaatgtgtgctattttcatttcttaaaactggaattatactgagttgttattatatttgacaaaaataagatagaatatttaaaaatcttttacaaaagatggcatcaccaaactgttgattcatgataacttttaatatctgaaataaattttgttcagtctaaacactgctaacaagaaaatatcatgtaagtttaaataccatttgatattctttgggtctttcagtttattttatttttacaaagttttatgaatggatttatttaagtaatattataatgtaaataacaagtcaaaatcaggggtttgaaagaatcgtttctcttaaaatgggtctgaaccttattcgagtttgggaaacactgggctataaaataaaattaaactttggattggtatgccaggccttccatgatctggccctcatggtaccattgcttcatgtcctgtcagtctcttagtcaaacctgaggtcccaccaacactgtaatttccatgtccttattctagctgttccctctacccaggacaaccttataaacctactcagaaaaaataacacatcacagaccatagataggtcttgggattttaatcctcccagaatgacaattagaaattacctactcaactgaacaaaatggtacaatctgtctaccatctcatcatgagatatgtatgaagcagtcttccacattattgtgagggatagactgagcacctgtcaggccaccacaaggaagtcaatacgttccctctaagccagagaagccaggaccaatagcccagacaaaacggaaacttcaaaaaacaggcccccatcaggcttaaaatggtcactcccagtcattccccacaactgtcttaagcattttgcttgataaatacagacttttgaccagaagagataaacaactttgatgttaaggttgttatcatttgtgataacatttcgattgattttaaactttcaatggtacttcaatgatgtcaataatacaaacctgatttaaagctgggaatctaaaatgaagtcaagtatttgctgaaacatttctttattatgttcaaaatggtaactttcatatgaaaaaaagattgacaacctgtgtcacacctttactaagacttcacaaactcttttgtggccagtgttacttctgctttcataatggccgcttaaagacatcttgtattgtttatactgacaacacatctgtatttcttattgttgactcaaaatcctctctcattaacttgaattaaaatagaaaatagcactggtcaggcctaaaactactcagcaaacatgcactttaacagtaaatttacaactctttacaacagaaaccgcgcactcttctttaattgctacagagaggtcagtctttcaaaccaaataagagtaagagatgctgcttttatcatagccttatgcaattgtaaaatagagagcaaactaaggtctgccgttctttctccacctgcttacttttggttatatctcatgacagattttgaagccgatttcaaagggcaacatctgttgtttgaactatgcatggaaagtttacataaagctaaatttatagatagctaaggctatgaaaagtattagaagaggatgctgaagatacaaaagtaaaataaatggtgaatttggatgaatcgtagtgaattaattctctaattgcattacttattctgttaataggaagacatttgagcaacttatatatggaggggttcagggcatgatgccccagaatgtggctccttggcctttgataaaacagcagaatgaggaaggtcagtctctgaccttctcccatccttctcccctgaagtaggtcacaagaccctcattagagaggtattctggcagaaagaaacatccttatctctgaaaagacagagaagaatctgaacaaatggccttaacaagtttattaccattacatcctagaccctttgttcatcacactttcccacaactgtccactttgggtcaaacctaagcataaagacgaacaggtttcctgtttctttaggtcttcatttctgaaggctctcatgtcatgtaaagcttatatcaaatatatttttatgttttcctcttgttaatctgtcttttgttacaggtgcctcagccatgaacctagtattggatgtggaaaataaatcttcacccatttataatattcatgactccaaaacatgtcctcttttaatatcccaagctgggttttattccaggcctccctaggggtgtcatgggagaataaatggcaaatttagaattctttatacattatattagccacagatatatatatacatatatatatatatatatatatatatacacatatatatatatatatatatacacatacatatatatatatatatatatatacacatacatatatatatatatacacatacatatataccttttatttttttgagatggagtttcgctcttgttgcccaggctagagtgcgatggcgtgatctcggctcactgcaacctccgcctcctcggttcgagtgattctcctgcttcagcctccagtgtagctgggattacaggcatgtgccaccacgcctggctaattttttatttttagtagagacgggatttctccatgttggtcaggctggtctcgatctcccaacctcaggtgatctgcccgcctctgcctaccaacgtgctggggttacaggcgtgagccagcgtgccaggcctatatatatcttttgttaagaaattagaatttactctttaagatagagttaggcctagtggggtattttgaaaatgtttctgaaaattcgcctataaataaccctgataattttacactgtctttaaatttactggagttctaccaaatgcctaaagcaaataagtgtggatgttaaacattaaaggcaatacttctattccaacattgcaaataactgactgctctgaaccttacttatgaatggcgatacttatatgacatattaaagtttagagtgcaagatgtgttttcctgcctgggacattatatttgataattataaactgatattttaaaatgcatgcatgtctttattatttttaaaaaggtgggtttcaatatgaaaacacctttgtcatgttttccttcttgtgtgtttcatggattagaaagcaatttaagatttaaaaaaatgtttactgaccaacaagtgttttgtttagaaactgtgaaaaatagaattgctgagctaaagcaggcgataaaacagattgagtttgtaatacattacttacaatgtgtgcttaagacatccacaagtaaaatgtgtcttattataaaataaatatacatatatatacacacacacatagtgttttcaaagcacagtgaattaataccaacctcaaatttcattctcgctgcacaaaactaactttaaattacacagtagttttctcagaaaccaatgtcagatattaaagggtctcatccatctataaaatgtaatagttgaaagcatccatctgatagtctgggcaagaaagtgctaggtgaggaggaatgggataaggagaagtgacaggacagtcagaccttggtaaaaatcacttcattggtttaattgaacaatttctctaccatagagtaataaagaaaatatcacacccagtaacaatagatagtttccaagttaaaagaaaaatctgttgcacctcgttggcgtgttctcataacaagtagaacataaagttattagcatgcaccatattccattttaatttctgatctatttatctttctctttcattaaattattagctcctttaagacatatcagtatatctctaaaatctaacaaagaacacagtgcccaacacgtcgtagagaatcaaagagaattttttgttttctgttaacctttatgtttaatcattatgtctacgattcttatttgcataattatacctttaaaatacctaattggtgtgaaatgttttggatgtaccaatcattgttttttgtttgtttgttttttcttgagacagagtcttgctctgtcacccaggctggagtgtagtggcgggatctcagctcactgcaacctctgctttcaaggttcaagcgattctcctgcctcagcctcccaagtagctggaactataggcacccaacaccacacctggctaatttttgtatttttttagtagagatgaggtttcaccatgttggcctggctagtctcaaactcctgacctcaagtgatccacctgcctcggcctcccaaagtgctggaattacaggtgtgagccaccatgtccagccccaatcactcttttaaagcttttctgcattaactcattcatgttacaacaactctgtgatgtaggcactttgatgtacctgatttatccacagttgacagatgaataagcagggtatagatcagaaagtttaattttccaatgtctaactgtgaataagtggcacagccaggatttgaatctaggccatctaagtcatgagccatagcacatacccattacataaaatatctacattattaaaactaaacaatgctttggagtcaaagaatatttctatagttggggcaacaattttttaaattagtcatcatgattataatataaatattattatttaactgtaaatttaactagaggtggcaaaagtggatggctgagagtcgaggcaggtaaaaacttaacctgggtaatagtgaaggtgagcagtctgtcttcagactataaatcattaagtcataggcaacctgagctatcaggagaaagctcagaatatgacaggaagagaagggagctgaaatggaagatgtgaaaggtgttgtagagttcaaacttgcctgagctgatcatataacctgtttcaatgaacatctttatttctgccctcattttgttatttacctagatggttgttcagtttccatgtagttgtgtggttttgagtgagtttcttaatcctgagttctaatgtgattgcactgtggtctgagagactgtttgttattatttccattcttttgcatttgctgaggagtgttttacttccaattatgtggtcaattttagagtaagtgtgatgtggtgctgaaaacaatgtatgttgtgttgatttggggtggagagttctgtagatgtctattaggtccacttggtccagagctcagttcaagtcctggatatccttgttaattttctgtctcattgatctgtctaatattgacagtggggtattaaagtctcccactattttgtgtgggaatctaagtctctttgtaggtctttaagaccttgctttatgaatctgtgtgctcctgtattgggtgcaatcatatttagaatagttagctcttcttgttgcattgatctctttaccattatgtaatgcacttctttttctcttttgatctttgttggtttaaagcctgttttatcagagactaggattgcaagccctgcttttgtttttgctttccatttgcatggtaaatattcctcagtccctttattttgagcctatgtgtgtctttgcatgtgagatgggtctcctgaatgcagcacactgatgggtcttgactctttatccagtttgccagtctgtatcttttaattggagtatttagcccatttacatttaaggttaatattgtcatgtgtgaatttgctcctgtcattatgatatagcttgttagtttgcccattagttgatgcaggttcttcatagcatctatggtctttacaatttggtatgtttttgcagtggctggtaccggttgttcctttccatgtttggtgcttctttcacaagctcttgtaaggcaggcctggtggtgacaaaatctctcagcatatgcttctttgtaaatgattttatttctcctttgcttatgaagtttattttgactggatatgaaattctgggttgaaaattctctctccatatatatatagagagagagagagagtgtgtgtgtgcacatatttgttctctttctctggagaactctaacacatggctgttacaaatcataatatgtacatatttctattgattatctattaaggagtaaaatttctgggtcataaagtgtgcataggtctgacattagcagacaatggtaaacaatttctgaactaggtcaatttacactgtctccaatataagactaccatttgctctagagtctcaccaaaacttgatggcatcagtagtttttaatgtaaaccttgccattgttttgaagttattttaattaacttatcttggtctcaaatatatatttgttgttacctagaatgtaatctgctgatcatcagctaattatgagaatgagacaaggtttctgcttccatagctcagtggataaactgtcttcatggtaaaactgatcagcaaaaatatttctcaccatgctgaaatatgctgtgcttgttcatcacaatctgcctttctggtcttgtggtcaaaaagtatcatgctaatcctaaatgcaatctgttccttgctccatcaagttgatattagataaaaactgaccccaacttgatacctttgctagctccaaattggtgtgctaatgggtgatttggagatttacagtcttttaaaacatgatttttgtatatccccccaaatataaaagctcctcaagctgcttgctacaaacacctcctctcttcactgttgcctgcatgagagtcttctcttttccttctgcagctactgattcactgcaaaatcaactcagactaagtgcagattttaaatagcatggcgaattgaatgatcccagttttaaatatgtcaggaaggtaatgtggagttttctagtacagccattagttttcctcctcctgtgttgcagctgcaaacacattggcattctccaagactgcctcaatatactgtgtgtgctccacccacgattacaaaataattggagtgttaagagaaacatggcgtgaggtgttgggagttggaaggctggccttcaggagcaactctatcttctcccttccaggcacttgatttggtttttccttagttcagattcgattctgaatctgaaaatgttgcctaagccctaattcagaaatcctttgcaagagagctgaaaaatttgctccaaaaaagaaaaaggggagagttctagacagaagtaatcagctacctgtaatcataactttagcatgcttttaccaaaagatgattagaaggatatatctgcttcatcagtgatttttaagaaaaatttcattttcttattgatagaaagacacgtggataagtatactgataaatggctgagactatccagcacactaacaaggtagcttcacacatttctaggtgtgaaaaaagtgctgggaatgttaagtggatgtgactacaacatcccctaaatgagaccagctttctttcagctcttttactttcaactaaaagtgaaaaatgtttatcagctgaggtcaggcactggaaatgagtagtgaatgtaaaatacaagctgtacagaattgttccacatctaaacctgtgggtggatatttgtgcaataaccccaagggtctactttattttaacttttcagcataactgaatggcatagcaagtcacttatctgttcaaaattcatgagagagacagaaaattgataaactcttgcaaaaatttcccagccttctttctaagaagaaccacaatggaaatttgctggcaaaactaaaaaattattgtaacaatattagcaaggggcatgctttagccttcagtgtttaaaaaaaaattcccttcctcatgtacacaacttggtatactcttagcaaagtttgttatactcttagccttttggaaaaggagaaagcttttggtatgcccaatatgaaacaaatttttataatctttttgtaataatttaaagtaagtctatgtcatttcagaatgagcacagtggaaatgaacaatttttacaagtagtgaaatagtcaatacacaaagtattatttattgttgttaatatgtttcaaataatgttaacagttcctagcacatagtaggaacatagaaaatatttgtttctttcaatatcagtcattttttattggcgaccagctaaaatacgctctagctgatttaagtggaaaagggattcattaaatagatattagatgcttctcagggtgatggggaagcctgaataatgtggctcaagaaataggcagtaaacaagtgtctcatattttcagctccctagtcatttatgtatcagtcatttattgcttgtttctttcctaaataaatgatatattctcttttcctgtgtttgaggatcactttgaagatcctcaagatcctcaaacataggaaaagagaatatatcgtttatttaggaaagaaacaagcaaacaaatgatgatgaaaatggtgtccaatgaaaatactaaaacgtatgattacatggtttatataatttgggtatcaattagtttggttaatataaatagacaatgtggaacttttaaacagaaggttaaagccttctctttatcttcacctgtggaaccctcagaacttcagattagtgttaaatccattctgttgtaatgagcacctttctaagaactggaagcaaatctaaaaggaagtcattgaaatcagagggaaaataaaatattctataactgataaaggggaagtgttattaaccagtttaatggatatatttttaatacatagtagaaatgtctttgtttgtagaaatgctctaacaaggactcacttcatttcaactgcatcacagcttacctgtaatgttttgggaacttaaaacctacaattcttcatttaacatacggagtcaacctttatttttaatgccaattcttgatacttaaaataaagtttcaaataaagtgacaataaatgtatcaaaaggtcttcctaggatagatagcttgatatttttcattgccaaaatctcataaacaccaagttgcatacatgaattatattcacacagcatacggaagtttttttttctaaattctctcatttgagtatttttttctcaactactgggccatgactcatgagcatgtggagcagatgtacttggttttatttatctatttatttatttgcatctggtttgcataggacagaataaacacaaaataaggacctaaaattgcttacttgggtgattgaatgcatttatcaggttggtctattactatcttaagagctacacgatacaggccaggcgcagtggctcatgcctgtaatcccagcactttgggaggctgaggtggggtggatcaagaggtcaggagatcagaccatcctggctaacacggtgaaaccccgtctctactaaaaatacaaaaaattagccgggcgtggtggtgggcgcctgtagtcccagctagtggggaggctgaggcaggagaatggcatgaacctgggagatggagcttgcattgagacgagattgcaccactgcactccagcctgggcgacagagcaagactctgtctcaaaaaaaaaaaaaaaaatggagagagagagagctacacaatacaaaatgccaagttatatttcataaaaatttcaatgaaatagtaattatttttctatcattaatttttatcacgatattacaagtgataagaaagaaatcagaaacattttctgccaaagtaaaatgaggtgtatcattcatataataacatgaatattaagcagttttcatatgctagcctatttaatcctcacaataattcagtgtgggaaatagagttcaaggtacccttgaacaacaagggggttgggttgctgacccctcatgcagtcaaaaattcacatgtaacatttgacttcccaaaaacttaacttctaatagcctagtgttgactagagccttatgggtgacataaacatattttgtatgttatatgtattatacaatgtattcttacaataaagtaatctagagaaaagaaaatgttgttaagaatatcataaggaagagaaaatgtatttactgttcattaagtggaagtcaatcatcatagaggcctttatccttgttctcttcaggttgagtaggaggaggaggaggagagttggtcttattgtctctgggacggccaacgtggaagaggcaaataaggtgaaaggagaggcaggagaggcaagcacacttcctgtaacttttactgaaaataatgtatgtataagtggaccctcccggttcaagagtccaccgtattatacttaatttgtttttagagatgaagaaacagagcaattagaaatttgcccaaggtcacatacttgtaagaggtgtatatatatatatatgtatatgtatacacgtatatatatatgtatatatatacacgtatatatatatacgtgtatatatatacacacactatatacatataatatacatatgaaaatatatggcatatattatatagaaaatatatattaatatagatcgctacagaaaaagatttaaggagtttgaagcaatataatcagtgaattttaatagaaaagactcacgaaatgcaacactctaccctactttgttaaggtcaacagatgctcagattgcctttataatgcaataatatgtttaatatttttttcttatttttttagacagagtcttgctgtgtcacccaggctggagtgcagtggcatgatcttgactcactgcaacctctgcctcccaggttcaagccttctgagtagctggaattacaggcatgcaccaccacatccagctaatttttgtatttttagtagagatggggtttcgccatatgggccaggctggtcttgaactcctggcctcaagtgatccacctgcctaggtctcccaaagtgctgaaattacaggcatgagccatcgtgcttggccttgataatgtttaactcatcccactttcatacctcaaacaaccagtaaattagtatactgttccatttgtctgtatagcacctggtattcaagccattttcctaccagagaaaatattctccagagagaatattttttctttgctgaaataaaagttgatgggcagggtcttgcttttctttttttagatctgtatgaattaattttgctttgggctgaatgtttatgtccccttaaaattcatatgttgaacacctaatcaccaaggtgattgggccttgggaagtaattcaattatgagaaggaagccctagtaaatgagattggtgaacttagaaagggcaccccatagagtgcctttcttcttctaccatgagaggatacagtggagaaggcaacgtctatgaaccagaaagtaggccctcaccagacactgaacctgctagtgctttgatcttggatttcccaaccttcagaactgtgagaagtaaatttctattatttgtaagctaaccaggctatggtgtttatattacagtagcctgaacaggctaagacagatgtactctcagtccctggggaagtacaagttgtcctctttccccatttctttcctgtgtatgcactagccttagctctgctcttctttacataataatattacaaaataatttcatttacagaataatatcatttttgttgtcaatatcaattattttttatacaaggaattaaaaaccttgggtaacatttttctagagtcttactttctcttggttatgactttttcacccatttacacgtgtgacacatatatcacatgtgtaaatacgatgcatttgcacactgttgcaaatagccaaaatattccataataagataatttgcctgggcttagtggctcatgcctgtaatcctagatttttgggaggctgaagaaggtgggaggactgcttgaacacaggagttcaagaccagcctcggcaatacggtgagaccctgtctctacaaaaaataaaaaataaaatagcctggtgtggtaatacatacctatcatcctagctactcaggagactgaggcagaaggatggcttgagcctgggaggttgaggctgcagtgagtcacgttcatgccactgcgctccagcctgggtgacagagtgagactctgtctggggcggaggagggtggaggaaagaaagaaagtgagaagaaaagctttatatagcagagttgtctccatgttttctgaacactgtgcatcccagtctaaatcagtaatcatattgtaaagttcctcaggacctgactctgtttcttaagcagaaaataaatgtattgacatataaagggtagctcagaaaattaaagaaatatttgaagaacagttgtggggctggacaaatataagagcacttcaggcatctagggaatagaacattattattaaattatgtaacacactctctatgggataaatcagctaaaatgatcttcagtatttaattactccactccaggttagatcctataggaagtgcaactggacaaacatgaatcacttgcccacctactttctaggaaagcacagaatctcatgatggataattttgctaaatggtccatctatcaaagtgaaattgggagcttttaccagaatacaggaaaagtagattggcaaaagcaacagatttctattacaactgttaacaattttaaaatagtttcgttacaaagctgttgaatccacaacacagctgcaatcttagatcaatattttcagtgtcactcccccacctttaaaaaatctgaatatgacatcaattcatactttagacagttaattagattaagaccactactttattgtggcagaaaaataaagtttaatctgagattttagacgtcttcaaaattagaacagggaggtttggttgatctttgaagaattcattcctaaggtaagtgaaaaataacatctcaatacaaataaatgtatccatgaatgaaaggttagcatgtactcagtatctcaaccctttgttggaatgtgaggaaggctacatccttacagatctgacgttctgagactctcagggcacaggaactgataatactaaggcatatcaggccttcttgctcagtgcatctggggaggctattgtagttctaaggttataaacatgcaaacatatactgtcttcttcaaagctgcctcccccttgtctctcttattggcagcagaaagtagagcagagctacaaatcatgcacagcaatctggagatacggcagggcagcctcgtgtcggagtcgtaaatctgacaccctggccaatcagtgccggcctcattttattcacggcatgttcatcgtgcaggcaataggagcgggaggctgctttctgtccttggcttctaaccacatggttgcatcctggtgtgtttttctatttgtgtatatttgagagaacaataagttatgtttatgctttcctttcaagaaggagagtctatatttttcatccttggacttaatcagagcctaatttttgtaaaaaattcatttacttgaagtacaaagctattgtgtgttgcacttggggtttctttttgtgttgttttgataaagaaggattccaaggccaaagtttcccagtgtcattttaagtaagacctgcaaaatattcagggtcttaggtgaaaaaaaaaataccgagtagaaaaagtactcttccttaccatatgaccactttcagccttgctaggtggaaggaagtggctctgtcaagtccatattccagcagggctcaaaatttacatccctttgcatatttccattaaaaataatataagcttccaattcaaatgtataattttgcataatcattgcttcccatcttctctttgggtcggctaaaataaaagggaggagaaagcatagtttacagaaagtaagctttaaatggttgagccatttaaaatcaccatttttgttagtaaaatatagttcaacactgagtattttgtatgtttcaaagtaatataaaattattctatactaacaatgaaaattagagaataattatgactgaatgggaactaaaaactagatgggaataggtaaatggataaacaagtgtgaagaaagctacacatctcaaggttggtcttggtggtcatgactgtaatcccagcactttgggaggctgaggcgggtggatcacttgaggccaggagttggagaccagcctggccaacatagttaaaccccatgtctactaaaaatacaaaaaaattagctgggttcgggagtgcacaactgtattcccagctattcaggaggctgaggcataagaattgcttgaacctaggaggcagaggttgcagtgagctgagatcacaccactgcactccagcctggatatcagagtgagaacctgtctccaaaaaaagaaagaaagttacatatcccagaatatgggagcttggaaggattttggaatgagtttgtttaatgggtctctgaaggctatggagtcaaagacagtaagccaattagagggcactgggcaaacaggccccaaatagtaatcatatagaactaagccaagtagcaatcctatacccactcttagactataggcatttgttatcctcaagggaaactccaaattgggttcttctgcaaagcaataaacagtttgaggaaagttaagttccgagtgtgggtgttggttctaacagtaagatcatggtctgctacaatttggatgtttttatcccctccaaatctcatggtgaaatttaatcttcaatacagcagtgttgggaggtgagacctaatgggtaatgtctaggtcatagggctccgtgttaatgaatggattattatttttatttttataatggcaataccactaaaaaataactttcaggagtggattctttctcttccactttctgccacatgaggatacaatgttaatctctgtttgttcttgcaccttcttccacgtgaggatgcagcaaaaagccctcattggacaccagatgcaggtgccttgatcttggacttgccagcctccagagctgtgagaaacaaatttatgttctttataaattacccactctgttatttttgttacagcagtacaaaatgcactaggatatagtcattctgccatttggtggaaagtgtaatagctggttagctaacaggtccaggtcagacctcataaaacaccatgtacacagcctggtcaaatgtccaacttagtaaagaaaatcaaatagaaactgtactactgattaaagcaacaaagaaagtacctaacattcttatttcttacagttaagctgtgcttatgaaaagatctagcagtatcaagaaactcagatataagtctactctaaaagaaaacaaataactctgcacacaagtgagaacttagtaaaatccagtctataattaaaaatttgagaaagtattgcattcctaaaatagaaaaagtttggtatgtaaaaaaaaaatcagatagcaacaaaactgtcccagtttaaaatactaagggataaatttttaaagaatggggaaaagataaaaatacaaataaaaatataagatgtaaaggactgacaaaggaggtccctgagtaataagaatcatatatcaaaaaaaagccaactgtcaaataaattatgaaagaaaatttcctagagctgaaaacaggtattaaaatttagattcaaagggctttaaaggcccagaaacatacattttttaaaaagtcaatcatccttaatcatatctttatgaagttttagaactgcaactttttgaaggaaaattattctcaacttagaattctataatagtcagactacaaatcaaatgtaaatcttaaaaaatgtgcaatacgtagaataacattgggcctttgttttaacaaaaccattctttaaaagttacttcagagcttggcttggtagcacactcctgtaatcccagctactcaggaggctgaggcaggaagattgcttgagcccaggagttccaggtggcagtgagctatgatcacatctgtgaatggtcacagcactccagcctgggagataaagcaagactacatctctaaaaataaataaagaaagaaagaaattacatcaggatacgctctggaaaaatcaaagagtatttcaagaaaaggggaacacacaaggtcaggaaacagtggatccaaccatcagagttatgatgagaagcactgaaatggcagctgaacttgtgacctaaatcacaaccatgtggattaaaacaagaggaagcgattcttcatgaaagaggtttacagaaaacgtgaaactacagaatggctagtaagatcaaacatttaggaaaacacaaatacataaggcaaatcatgactaaaaaaaagaggaaagaaagaaaaaaacagttataaattcttggaaaaatgtaacatttcacaaaaagtcatggtccaattttgaagcaatgtaacctgcatgatggtttcaggcaattatgaaagatgatttattttaatgtgatgctaagaaaattctcctgtgtgtgacacaagagtgcagaaattggatcagagacaattaaatgcaatctacctataatactttcttggacaacaaaaaatacttatataattttaaaaagtaaaacagactttagcattaacccaaggacagtgtgtgttaagtctgcttgcagttggaatataaagtaacagttaatatgcaatacctcaacaatataaaagttgaagtgtgactgacataagatagtgtatttacatggaagagagaggagaaggaaagatcatgccaagagaaaatactgtgttaatagtcataatgtaaataattaaaattgcagttgaagtattttaatgttaaaattttaaccaaattataattcattacaatatatttatatgtattattatatataatataatgtataatgtctatttttatatatatagtagtattggagaagaaaatttttaaaagtagtatgagcaaatcaaatccttattgtgcacactgggaagaaagtagaaattttgtacaattgacagatcaagaaatagttgtataattatattacttaagatttttagggtttttcattctaaacagtggaacacaagttgaagaagagggaggcaataaactgtagctttttaatagtgagtttttctgtacagttttgattagttatcagggccatctattactccagtaaatattgaaatagaaaaaaaaggatggaattatatgaaaaaataataatggcctttattgctttatggtgagattacagattttttaatctactttttgcattgaaaacacttgcaataatgtatatatatatttttttgatgataagaaattcagaagtatccacaaataatttttttaaataatatttcattgtctacaatgtgttgtgtaatttgacagaaatttttatgctttttatctattctgtgaaatgatttatccatttgcgttcccacatgaataaactgaggctcactgaaactttttaactaacacaggttcacataaaaatatgccattgcttcaagcctaacttttggcttctcaaaatagctcaccacactctatctccaaaagcttatgacatgtgtagggatgtgactagtaatcttacaaaatagggacctgaaagatttactgcaatttacctgaatgaaaactgatttaacactcactacccacattaagatgattttttaaaaatagctgttaccataattaacccagatttataaatcatctctaaaaaaatctggccccattgatccaattggtttctgcacactcaattactaaagctgaacattctaaatagacttgcctgcccctttgtggttctgttgtgttgaccctacccttgttaaaagtatgtattctttattagactgctcatctttaaatgcctctcttcagcatttgttagttgtgtgacactgatattcccattttgagaccttcattcttcaactataaaataaaaatttaaaaagtactgcagttgaaaatgtcagttgtcttccaaacatctattcatccctttttcattgccaacagaaccccaatttgaggtctggaaatatgatcagctaaatgtatactacatctttctggctgccttaaagctaagggttgccatgtaacagttccaaccaacaaggtgtaagtggaagttggctgtgggtttttgagaaagcttactctttcttgatatgaacaacaaaaaaagaagatatggtttagactgtcctacctatctctgttttacttgcttcaaataaggacgcagtgcaaaaagccaggtctgcaatattgtgagcatgtggaggtaggtgtagtggaaaggacaagagaattgcaaaagttctaactttgatataaacaagatgtcagctgcttaacctttaaattttgtgtgacataagaaaaaataatgggtctaagccagtagaagtggccttctgccatttgtggcctaattaattgctttctctctctctcttttttttttttttgacaggattttgctctattgcctaagctggagtgcaatgacatatgattgcttactgcagcctccaactcctgagcttaagcaatcctaccacctaaccctcctaagtagctgggactacaggtacttttcaccatgtctggccaatttttaattttttttattttgtttttgtacagacaatgtctggctctgttgcccaggctgatcttgaactcctggcctcaagccatcatcctcctttggcctcccaggtgctgggtttacagggtgactcactccacccagatgtggccaaatgaatttctaatggattctaatgtctttttcacaggattaaatcaaacaatacatataaataattaagattagggccaagtacatagtgcataataattattggctacaatggggttaaaggaggaaattttaacatggcatagaaatttgcaccttgaaattcagcctttttatctcattgctcaggaaacaaatgttcagagcatgaaatcacttgatcaagataattcatgtgatctttatttctcttcataagttactattatgaaatgtgctatttattaatcatctgctatgtaacaggtgttccacaaaagtccgggtatagagtaatgccctcacaaaacttccttatagtgtcacacattctgggtctaaaacttgaattaaacccatttaagatttaattacatcaaatattaaaaagtgttgatactcaggtttagcttgaatcttagcagacaggatatggtctaattaaaccactaactacatctgctatttatatccattaactttaattttatagtgtagttcatagaaccaaagaaatggctgagatgccaggcttggttagggtagaaacaacggctaatccaatcatccaggtcgtaggagtcagcctaacctcagcattgacactagactatatcaactccaactcttgttttttctgttcttgaattcttccacttgactcagaaactagaaggggctggggaacgggatggattgttctaatttgaatgacatattcactccttggctaagagaggtacatcaccttgactgacagtccaccatattgctcacaatgggagtgaagttactccccaggaggagattagtgtgccacctccaaaagaaagtggaatgcagaacaattacctatgcaattactgaaaccagagctctagcaaaaagtataaaataaaaatgagagactatggaacttagataacaccctggttctgaatgggaggggggtggtagagctcaaaaagaaaatattagaaccctagccaagtcccagaattaccttagtcagtccctgtgtatcagcctgtggtattttgtgacaggaaaggaaaaacagtaaccctgccttcttactctttttggtataccttaccaattctcttttatattccaagaagttcttgcctgaaatatgtaacagttaagtgttgtttttctccttgcttatattgactttgtgaaaagagcttatgaaatgtagtgttgctcagtcttagaaaactaggccaggtatccaattagcatatctctcttgctcacaggactatcaggatgattaaggagtgttccttctagcagagaaaaaggtcttctgagctgggagtcagtttgacagactagtctttcattgacccccttcagctctcctttattttacccttgatttttaaggagggtgcttttactgttctttatatcactcttgctgtcattgttactgcagttgagaatgctttgattccccctctgtgtttaaattctttatcttcttctatttcacacattcaatgttgtagccaattgccaattctgtttgggcaattcaatgatgcataacacttttaagcagagtataactgaaagggcaaacttttgtaaaagattattattaaagataaacactttggatggatggatggatggttggatggatggatagatggatgccacaggttctgtatactgtgcagaaccccttatgctcatttctcatttctgagtgtcttttctcctgtttcagtgtgtcattgatctcaatcagctgtacctcaaagtcatatttggcacactctcctagggcaactgggacacttcccatagtcatgggcaaccagaagtgcttgggagtttacatcagtctctcaccttgaggacttcaatcagtggctgtatgttgtggaagtataaagtcccaggatctgatgagatcagaatgaagctacatttaatagggcttggcctgaaatcatacccttgcttggcttcttccccttcagtgtcatgtgcaaaatcccaagaaaagaactagttaatttgtctaagaacctcagaaaacactggcacagatagtgaagaagaggaaaagtagtataagatgaagttggaaagagacttaagagtcagatcatgccaagacttataaggagtctgagtattattcaaagcatcgcagttcacatctactagccttttctccttcataggaaaaactgcaatcaagaatggtagccacaatgggtagttgccatggtagtgaggacaagtagccaatatttacggtattgtcattgctggtaaaggaagcatagggtatacaactaattttctaatgcaattgttgcaattgttagccaggttgtaccaaaggaatcttcctattcttcatcacaaaataattatccttaaaaagagcttggaatcaagaatccagagatatagtgctaatattcaagagttttcacattatgctaaatttagccaaatgttgcaaaatcatggttaagttgacataggcccctgtctaagctgcaactcttggttgaacacatcaataatggtgtttaagcatcccaaattcgactgatggcagagaagccaaattgatcattttgatgtaaaatgaccttcatttgcttctgttatggttctgttctctagggaagaacaaataatttctaacctatgcttagctaggatgtgacactttattatcaatttattgataaggattatggtgtactatagattattatttatttatcttatgttagtttatcaccacttataatctgctaacttttctaaaaagtatcaatagaattagttttattttttcattgcattaagaagcacatttttaaataatctgaaattgtttttacataaacataatttatctaagatttagattttaataacactacattttgttagtgcagacttggcctccatgcttactaaaacataggtagtttaattagctgatcacaatatggaatatgactattagacgagaatatgttttaaaatttgttttaatatcctgtaagagaaggcaaatcaacaagcatgtggagagaaactcttttcttgatctacttacttttaaatatattttggcacataggaccattattcacaggatccaatttatttcaacttacaacttattagtaataataatatatgtagctttatatctttatgtgaaaatcccaactatgacttaagtgtgagtgtcatatcctgcaatttcacagatacttagaagtgatagatgaaaatcatatatattcttcttgtttactgaagatatttaacaccagaaaaagattaaggaaaaagaaacactctccatatgtattcatacatttttaatgagaaaaaaagaaataagctctgtcaaagtgctatttgtagctatttccaaatttaattttatgttttaaaaagtttttgaagtcccacctaagataacatctgtgaggccagaaataaataaaatccaagtgtatttaaaagaaactaaggattaaaaggtgagcagaacctgaagtggataaaaatttgtcttttcaatttacttggtgttcattttgggaaattagcctcgtgacccccagcctaaatgacatcatccagtgaggttgctaaatcagtgtgataagacccctggaattgaggaagtttcaagaaaggatgctgaaaatctaccatacattgagttactgtagattaatggttcatggcattatcttatttactcctaagaacaactgtatacattagatattattatcttcattttatagaagagacaccaagtgttggagaggctaatgacttaacatagctattaatcagcagaggtacatttaaaatctgaatccaaatccagaaatcacaaagctagcatatcccctctagtaccagcctggtaattgtgatttatgtgcttaataagaaatcagatctgttttcatgaacactatgtttaataaatcatcttattgaatcagaggtcctaactgtctagcctgaactaaccaactgggttctagtaatcaagcaattaaagacaacagtttggaattgtaggtgacataaggcaggtaaataagaaggaatcattcctggttttgcatagccacatacagagcacagtgcctagagcagagcattgcagatccattgaatctgcttttaagatccatctagtgtgcctagaaaagaaacaggaaagaaatcacaaactgttaacagatagaataatttactaaaaatgtcatactgcctgtcactggtttattataagtagcataattcaaatgaaacctacatgggctccaaaatgttacacctagaatacagcaagatttgaccatgactaccctaaatgatatatgatcagtccattttcctttgctataaaggaatgcatgagactaggtaatttataaagaaaagaggtttatttggctgacagttctacaggcagtgcaagcatagcaccagcctctgctcagcttctggtgaagcctcaggaagcttttattcatgacagaaggtaaacagggagcagacatgtcacatggggagaaagagaggaagagagaaggcaggccaggctctttaaacaaccagctctcacgtgaacccgagctcactcattactgtaggaagggcacaagcaattcatgagaatctgacctcatgacccaaacacctctcattaggccctacctccaacactggggatcatatttcaacataagatctgtaggggacaagcatcaaaactaaatcaatatagttcaccaaacatatgcacagtgattcttagtcaacatcaggttggcagatctaccctgtgagatttatctagctatttaataactgccaacatactactttttaatctgactttaaatcaaatcatcacgtatatcataccagaaagcaaattagaattacatgttattaatttaccaaggaaagccatgtgccaaaaacatcttttggaatacaggaaaattgatcagaaatttaacttctaatttaatattggttccccatttattggtagtaaactataaatgctaatatccgatggtaggattaggatgagactctttgacctagaacaagaggatgaggcgtttgcgctcagctttgtagaaagctttgtagcttgggaacaaacaaatgctcatcattagcggttcagtttcttcaacttctctttctctttttcttcgcctatcaatcttataaggtttgtttctctcctgttccgttcaaagatctttgctctaataaaaagcacaatttaagaagttttctcattctggatatactttttactgcccaaagtacagcacagagaattaagttttcaaaaaccaagtgatatagaagaaagaaaaagagattaaagaacatgaaagtgctacagagactcaataaaatatatgtagtttttttaactctgaattttcctcttttgaagacaaccaaaatcttttaaaacacattatcttaaactattttttatttgtatcagttctccattaagttatgaatatatatttttaaaacagctttggaaaaatacattttctgttttattttgttctacaaaatatagatagaatacttctccgaaagatactattttcctagtacacaggatatgaaatctcagaaaagtataaaaaaagaatacaaagcttataggcttgtgatgggacttaggagaaaagtttggacaaagggacaagcatacaatgcatcttccttctcttcagacagaaacagtattaataccaaaagaatatgtaaaagtgagcaattccctctgtattcacacaatccaagcgagtgtgaatgataatgggatcttgaatctctcgtaccagacatcagtaaaaaaacaactatgtcctgtcagccttataacaaaggagcttattaagataaatgatacttttaagataacatctaccataatatgctacacttggtattcaaatgtaaaacaagccaaagtcaatatatccattgttctccctcttaattctttgccttaatctccttcacaacaaataaaattgtaaagcaaatcaactgctcaaaactaacagtgccacttgtcctatgtcaaaatttgtctaggacagtctaaattcaaatattcaattcttctatggacaatgcaaatttatttatatcatgcttccttttaacaaccttgataggaatttcaaaacactggagattaactgagtaaattatgattcaactctataatatatagtatgcaactaaaaagaatatctaatgataaaagaaaatatttaattattttgctaaatgcaaaaagcaagtttcataattttatattcaatatgtctacattttatagaactatacagatataatgaaagaccacaaggtcatatgccaaaatattaatagtaattttttaaaatgatagacttccaggtatcttatatgattgacttgcatttcttttgatctcaatcagagtagttgaattattttcttgtgaaaatgtactatccttgtttttgtttctgtatgttttctctatgtaaatcctagcttttcaaataaccattcaaattcttatgctttgtattttattttcctgaacataccagctaatgtaaaataatctttctttccaattcttgaaaccaaatgtaagctccttaagggaagaatctataacaatttgtacttcccacagcaactatattagcagagaaaaatgatttggtaaataaatacctgtgagattaaaaagaaaatcttaaggatgtaatgagatttgcatacacacagacacactctcacactttctttaagaggaggctcttcagtcctatttatttcacccaactctcatcaagttgcagactctgaaccaaaaggaatcttaggaaccctccatactgtgctgatttctcctccgtaatagtctctttgcatccagctgggcttgaatatcttcagccacagaaaaatcacttaacatatggagctcattctattgctacatatgtcctaaatactaaaacattattttaatgcttagccacaacacacacatgcttaaatttaaaaaaaaaaaaagtcagtaccatcccctaggtaatcatgtttgtaacactttaatgagtttaaggcctgagctctaaattataatcaaatgttaagttaaaaaaaatgaagcatatagaattttctgctttcttcatgttgattgcttccttatacttccttattttcaatatgtatcttacttatttaaggtatattttaaaatttaatgtgatggcagaaaacaaaatatgaaaacaatgcatactattatatatttatcaagatttgtgtaatttagaccatcatttgaatcttacttcttatatttcgatattttaagaattaagcttatataggtaaagaccaaggttacagttttactataataagttatataaaaaacaaatatattgaagcagagcacagcaaacttttcctgtaaaggacctgatagtaaatattttcagctttgggaactatacaatccctgctacaactattaatctctgtcattatagggcaaaagcagccacaaataacatgtaagtgaatggcgtgtctgtttagctgtgttccaataaaactttatttattaaaaacaagcaagatttgaatttggcctgatgtaaacatagtttgataatccctatactattgggattactcatgccattgtcctaatgaactacatagtttaaatctattccatcaataaggctatgtgcatcaggatttattcaattgaacgtgtatttgttaagctcatcatataagctcagcattgtaatcaatcaggctttatacagtcttatttaagattgcctagaaaaacagactaaagattatgcaacaaatttgagacatccaagtggcaaaaccaagtaattcaacatgaaatatttatttgaggatatgaaaaaacaaatgtacatgcgtgtgtatgcacacaggcacctgtaacaatagccttgttttcctctcttaggaagatataaataaaagcttaaatggctttcatgagagtagaagagatatcatgttatttcgttctctttttaaagcattctagaataaataaacagtagttgccagaggacctactataagcaattctggacttgacccccaaaaatgttacctctcaaaatatttctgaaggatgagctgaaggggagtaaacagtgacttaaaatctgatagtagacacttttcatgatccttgaacaaggatctatcattatgccttagtgtacctctggttcataactttgacacacacaatgattattcctcagtggtaatgaaatatttattaaatacagataatatttgatagggtttagatatctgtcccttttaaatcagctcatgttgaaatatagtccccagtgttggacgtggagcctgatgggagatgttcggatcaggaggtggatcactcatgaatagccttgtgccatctttttggtaatgagtgaattctccttctattagtttacctgagagttgctgtttaacccattctccccaagaatattcgctggtggtgcttgtggctgcagagtttaccctgagataactcgtgggttacagttctaaccttacccccaaagtttgccagggaatatctcaattttattattattttcacattgctctaatatatcaacttgggaaacaaaatacatcattctatttatagcattctgtttttagtagtggtatttctatttacaaaatatagtaattctcaattgctgaaaatgtcaaattctatacaacatagaattcgacattttctgtgttgttccatgcttcaaaatttgaaatttactaacagataaacattattaaatactgatcgtcatatacatttctattacattaagattagagacaagttctgtttacaaataactccaagaacagtttttagattttattttcacattgaaaatcaattagatttgctcctacctcaaagagcatgtttgtgtaaaattaaatgagtactggcagtgagctgcactttttttttctaaatgagaaatgggttaaaagagtgttgcacctcttcctctcactcattccctttcttgtcatgtgacatgcctgctccctctttgcctcctgccatgagtaaaagctgcttgaggtctcaccagaagctgagcagatgctggtgccccacttgtatagcctgcagaactgtgagccaaataaccccctctttttaaaaaataaattacccagcctcaagtattccttcatagcaatgcaaaataaactaatacagaaaattggtactaagagtgggctcttgtataaagatacctgaaaatgtggaagcatctttgttactgggtaacagtcagaggttggaagagtttgaaggtctcgaaagaagacaagagagaatttggaactttttagagacttgttaagtagttgtaaccaaaatgctggtagaaatataaacagtaaaggccaggctgatgaggtatcagatgaaaatgagaattttttgaaaactggagcaaaattcacccttgttacatcctagcaaagagcttggctgcattgtgtccatgctgtagggatttatgggatgtttaacttaagagtgttgacttaggatatctgacagaagaaatttctaagcagaaagcattcaaggggctgtgtggctgtttctaacaaactacaacaagatgttggaacagatgtattacttaaggttaaaaattataataaaaagcaaagcagagtgtacaaatttggaaaattcataatctggccatgaggtagacaaagaaagacagttttcaggagaaaagcagaagcagctgagaaataaccaattgctagagagacttgcatgactaaaatggaaccaagtgctgatagccaagacaatggaaaaaagaccttgaagacatttcagaaatcttcaggagagtccctgccatcacaggcctagaggcctaggaagaaagaatgcttctggggacaatgcctgggagaccactgctctgcaccacctcaggagagtgtgccctatatcctggctgcttcagccccaaccaaagctgaaagggcctgggtatacctaagctcccattatggagagttcaagccactgtaagcattggcagcttctacatggtgttaatcctgtaagtgcacagagcacgagagtgaaggcttagtaacttccacttatatttcagaggatgtattggaaaggctgggtacctaggcagaagcctgctacaggggtggagcccttgcagagagcctatactaggatagtgccaaggggaaatgtggggttgcagcccccacacagagtcaccacccgggcaatgcctagtggatttgtgaaaatggggccaccacctttcagatcccagaatataccttgagcctggaaaagtcacaggcattcaactccaacccgttacagcagccacatgggcttcaccaaataaagccatggaggcagagctgcagagctgcccaaggccttgggaagaccacctgtcatttttctccaatgtagtagtttctccaataacccatggtacctcccaccaagacctgagtcctcaaaatatctattgaatggttgtactcttaggggtgtagttataataataatgatatacttcagtattaaattttaaattttatggagtaatgataagcaataaaaataaaacaatacttcttccttgtttgctaaattacaagtagcaagccattcaggggaggagccaagatggccgaataggaacagctccggtctacagctcccagcgtgagcgacacagaagacgggtgatttctgcatttccatctgaggtaccgggttcatctcactagggagtgccagacagtgggcgcaggtcagtgggtgcgcacaccgtgcgtgagccgaagcagggcaaggcattgcctcacctgggaagcgcaaggggtcagggagttccctttcggagtcaaagaaaggggtgacggacagcgcctggaaaatcgggtcactcccacccgaatactgtgcttttccaacgggcttaaaaaacgacgcaccacgagattatatcccgcacctggctcggagggtcctacgcccacggagtctcgctgattgctagcacagcagtctgagatcaaactgcaaggcggcagcgaggccgggggaggggcgcctgccattgcccaggcttgattaggtaaacaaagcagcctgtaagctcgaactgggtggagcccaccacagctcaaggaggcctgcctgcctgcctctgtaggctccacctctggggacagggcacagacaaacaaaaagacagcagtaacctctgcagacttaaatgtccctgtgtgacagctttgaagagaacagtggctctcccagcatgcagctggagatctgagaacaggcagacggccttctcaagtgggtccctgacccctgacccccgagcagcctaactgggaggcaccccccagcagggacacactgacacctcacacggcagggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacaaaaactggaaactctaagatgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtctagagaaaaaagaataaaaagaaatgagcaaagcctccaagaaatatgggactatgtgaaaagaccaaatctacatctgattgatgtacctgaaagtgatggggagaaaggaaccaagttggaaaacactctgcaggatattatccaggagaacttccccagtctagcaaggcagcccaatgttcagattcaggaaatacagacaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaataatcagtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacgcatcagtgtgctgtattcaggaaacccatctcacatgcagagacacatataggctcaaaataaaaggatggaggaagatctaccaagccagtggaaaacaaaaaaaggcaggggttgcaatccacgtctctgataaaacagactttaaaccaacaaagatcaaaagagacaaggccattacataatggtaaagggatcaattcaacaagaagagctaactatcctaaatatatatgcacccaatacaggagcactaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttcaaaccaacgagaacaaagacacaacataccagaatctctgggacgcattcaaagcaatgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaagagagaagaatcaaatagatgcaataaaaaatgataaaggggatatcaccacggatcccacagaaatacaaactaccatcagggaatactacaaacacctctacgcaaataaactagaaaatctagaagaaatggataaattcctggacacacacactctcccaagactaaaccaggaagaagttgaatctctgaatagaccaataacaggagctgaaattgtggcaataatcaatagcttaccaaccaaaaagactccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgaacaagtgggcttcatccctgggatgcaaggctggttcaatatacgcaaatcaataaatgtaatgcagcatataaacagagccaaagacaaaaaccacgtgagtatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcgaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccacttctcgaggaaataaaagaggatacaaacaaatggaagaacattccatgctcatgggtaggaagaatcaatatcatgaaaatggccatactgcccaaggtaatttacagattcaatgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaagaactccctatttaataaatggtgctgggaaaactggctagccatatgtagaaagctgaaactggatcccttccttacatcttatacaaaaatcaattcaacatggattaaagacttaaatgttagacctaaaaccataaaaaccctagaaaaaaacgtaggcattaccattcaggacataggcatgggcaaggacttcatgtccagaacaccaaaagcaatggcaacaaaagacaaaattgacaaatgggatctaattaaactgaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcgaaggacatgaacagacacttctcaaaagaagacatttatgcagccaaaaaacacatgaaaaaatgctcatcatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgtgtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagtcatcaaaaatgatgagttcatgtcctttgtagggaaatggatgaaattggaaatcatcattctcagtaaactatcttaagaacaaaaaaccaaacaccgcatattctcactcataggtgggaattgaacaatgacaacacatggacacaggaaggggaatatcacactctggggactgttgtggggtggggggagtggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaataaataaataaataaattacaagtagcataaactaagatggatgtgtagatagatacataggccccttgttatgttttcttatctttcagaacaaaaaagtagacaagtttcctagtcaagatattccttagctacagcagtcacaggaaaattatagcacatgttacctctaatcatatatctgtctatagaatgattcatcctgcatgtttctaacagagcgatcattgctcagcacaaccctgctcatttaattactcctcagaatcctcaagtggctctcaatacttccaaaatacaagtcaaatcaggtttgcctgtcttccaaactcctcaacaattcaactctcagccatctttcattttgaaacacaggttgttttggtagaatttacataaaataaaatttactctttttgatgtataattctatgagttttactaacgtatatagtcatgtgactacaaataaaatcaatatatagaacattttcatcacctgaaaatgtaaccttctgcctctttgtaggcattcatctccctcagtcctagccagtggcaaccactgacttatttcttgtccttcaacttgactcctagaaactcatgtaaacggaatcataaaggatatagccttttaagtacgtattgtttcactaacttaatgtatttgagatttatccatattgttgcttatttagtaggttgagcctttcactttttattgctatcattccattatatggataggccaaagtttgtttaaccatttgtccattgagagatatttatgtggggatttgctgacaagatggccaaataggaaaagttccagtctgcagctcccagcgagatcgacgcagaaggtgggtgattcctgcatttccaactgaggtaagcagttcatctcattgggactggttggagagtgggtacagcccgtggagggcaagccaaagcaggatggggcatcacctcacccaggaagcacaagggttgggggaattatctccccgacccaaggaaagcagtgaggcactgcaccatgaggaatggtgtgctctggcccaggtactgcacttttcccatggtctacacaacccacagatcaggagattccttctggtgcctaagccaccagagccctggatttcaagcacaaaactgggtggttgtttgggcagataccaaactagcttcaggagttttttttcaataccccagtggcgcctggaacaccagtgagacagaatcgttcactcccctggaaagggggctgaagccagggagccaagtggtctggctcgggggatcccacccccatggaggccagcaagcttggatgcactggctggaagttctcgctgccagcacagcagtttgaggttgacctgggatgctcaagcttggtgtggggaggggcctctgccaatgctgagacttgagtaagtggttttacccttacagagtgaacaaagctgcagggaagttcaagctgggcagagcccaccgcagctcagcaaggccatggtggccagactgcctctccagatccctcctctctgggcagggcatgtctgaaataaaggcagcagccccagctgcttatagataaaacctccatatcccagggacaatgcacctaggggaaggggcagctgtgggcgcagcttcagcagacttaaacattcctgcctgacagctctgaagagagcagcagatctcccagcacagagtttcagctctgctaagggtaagacttccccatcaagtgagtccctgacccctatgtatcctgactgggagacacctcgcagtaggggctgacatacacctcatacaggagagctctggctagcatctggcaggtgcccctctgggacgaagcttccagaggaaggaacaggcagcaatctttgctgttctgcagcctccactggtgattctcaggaaacagggtctggagtggacctccagcaaactccagcagatctgtagcagaggggcctgttagaaggaaaactgacaaacagggatagcatcaatatcaacaaaaaggacgtccactcagagaccccatctgaaagtcaccaacatcaaagaccaaaggtagataaatccactaagatagtgagaaaccagtgcaaaaaggctgaaaattccaaaagccagaacacctcatctcctccaaaggatcacaacttctggccagcaagggaacaaaactggatggagaatgagtttgacaaattgacagaagtaggtttcagaaggtgggtgataacaaactcctccgagctaaaggagcatgtttaacccaatgcaaggaagctaagaacctggaaaaaaggttagacaaattgctaactagaataaccagtttagagaagaacataaatgacctgatcgagctgaaacacagcattaaaacatcctgatgcataaacaagtatcaatagctgaatcaatcaagcagaagaaagcatctcagacattgaagatcaacttaatgaaataaagtgagaagacaatattaaagaaaaaagaataaaaaggaatgaacaaagcctccaagaaatatgggactatgtggaaaaaaactaaatccacatttaattgttgtacctgaaagtgacggggagaatggaatcaaattggaaaacactcttaaggatattatccaggagaacttcaccaacctagcaaggcaggccaacattcaaattcagaaaatacagagaacaccacaaagatactcctcaagaagagcaaccccaagacacataattgtcagattcaccaagattgaaatgaaggaaaaattattaagggcagccagagagaaaggtcgggttacccacaaaggaaagcccctcagactaacaggagatctctcagcagaaaacttacaagccagaagagagtgggtgccaatattcaacattgttaaagaaaagattttcaacccagaatttcatatccagccaaactaagcttcataagtgagggagaaataaaatcctttacaaacaagcaaatgctgaaagattttgtcaccaccaggcctgccttaccagagctcctggaggaagcactaaacatgcaaaggaacaactggtaccagtcactgcgaaaacataccaaattataaagaccgtcgacattatgaaaaaactgcatcaattaacatgtaaaataaccagctagtgtcataatgacaggttcaaattcccaaataacaatattaaccttaaatgtaaatggcttaaatgtcccaattaaaagacatagaccggcaaactggataaagagtcaagacccatcagtgtgctgtattaaggagatccagctcatatgcaaagacacacataggctcaaaatacagggatagaaaaagatttaccaaacgaatggaaagcaaaaaaaaagctacggttgtattcttagtctctggtaaaacagactttaaaccaacaaagatcaaaagagaaaaagaagggcattacatattggtaaagggaccaatgcagcaagaagagctaaccatactaaatatgtatgcaccaaatactggagcacacagattcataaagcaacttcttagagacctacaaagaggcttagaatcccacacaataataatgggagactttaacaccccattggcaatattagacagatcaatgagacagaaaattaacaaggatatccaggacttgaactcagctctggaccaagcagaactaatagacatctacagaactctccaccccaaatcaacagaatatacattcttctcagcacctcatcacacttattctaaaattgagcacataattggaagtaaaacatgcctcagcaaatgcaaaagaatggaaatcacaacagtctctcagaccacagtacaatcaaagtagaactcaggattaagaaactcactcagaacagcaaacaacatggaaactgaacaatgtgctcctgaatgactactgggtaaataacaaaataaagacagaaataaagatgttccttgaaaccaataagaacaaagacacaatgtacaagaatctctaggacacatttaaaagagtgtttagagggaaatttatagcactacatgcccacaagagaaagcagaaaatatctaaaattgacacactaacatcacaattaaaagaactagagaaggaagaacaaacaaattcaaaagcagcagatgacaagaaataactaagatcagagcagaactgaagaagatagagccatgaaaaatacttcaaaaaatcaatgaatccaagagttggttttttgaaaagatcaacaaaatagactgctagccagactaatagagaagaaaagagagaagaatcaaataggcacaataaaaaatgataaaggggatataaccactgatcccacagaaatacaaactaccaccagaggatactataaacacgtctatgcaaataaactagaaaatctagaagaaatggataaattcctggacacctacaccctcccaagtctaaaccaggaagaagtcgaatccctgaatagaccaataaaaagttctgagatggaggcagtaattaacagcctaccaccaaaaaaaaatcctggaccagacagattcacagctgatttttatgagggatacaaagaggagctggtaccattccttctgaaactattccaaacaatagagaaagagagaatcctttctaactcattttatgaggccagcatcatcctgataccaaaagctggcagagacacacacaaaaaagaaaatttcaggtcaatatccctgatgaacatcgatgcaaaaatcctcaataaaatactggcaaaccaaatccagcagcacatcaaaaagcttacgcaccatgatcaagttggcttcatccctgggatgcaaggctggttcagcatactcaaatcaataaacgtaattgatcacagaaacagaaccaatgacaaaaaccacatgattatctaaatagatgcagaaaaggccttcgacaaaattcaacaacgcttcatggtgaaagctctcaataaactaggtattgatggaacagatctcaaaataataagacctatttatgacaaacccacagccaatatcatactgaatgtgcaaaaactggaagcattccttttgaaaactggcacaagacaaggatgtcctctctcaccactcctattcaacacagtattggaagttttggctagggcaatcaggcaagagaaagaaataaaatgtattcaaataggaagagaggaagtcaaattgtctctgtttgcagatgacatgattgtatatttagaaaaccccaacatctcagcccaaaatctccttaatctgataagcaacttcagcaaagtctcaggatacaaaatcaatgtaccaaaattacaagcattcctatacaccaataacagacaaatagccaaatcatgagtgtactcccattcagaattgctacaaaggcaataaaatacctaggaatgcaactcacaagggatgtgaaggacctcttcaaggagaactacaaaccactgctcaaggaaataaaagaggacgcaaataaatggaaaaacgttctatgcttatggataggaagaatcaataacatgaaaatggccatagtgcccaaagtaatttatagattcaatgctttccccaacaagctaccattgactttcttcacagaattagaaaaaaaactttgaatttcatatggaaccaaaaacaaaagtccacatagccaagaaaatcctaactaaaaagaacaaagctgggggcatcatgctacctgacttcaaactatactacacggtgacagtaagcaaaacagcatggtactggtcccgtaacagatatacagaccaatagaacagaacagaggcctcagaaataacaccacacatatacaaccatctgatctttgacaaacctgacaaaaacaagcaatggggaaagaatttcctatttaataaatggtgttgaaaaaactggctagccatatgtaagaaactgaatctggactttccttacaccctatacaaaaattaactcaagatggattaaaggcttaaatgtaaaccctaaaaccataaaaaccctagaggaaaacctaggcaataccattcaggacataggtgtagacagagacttcatgactaaaacaccaaaagcaaaggcaacaaaagccaaaattgacaaatggaatctaattaaactaaagagtttctgcacagcaaaataaactattttcagagttaacaggcaacctacggaaagggagaaaaaatttgcaatctatccatctgacaaagggctaatatccagaatctacaaagaacttaaacaaatttacaagaaaaaaactcagtggccaaaggctatgaacacacacttttcaaaagaagacatttatgcggccaagaaacataaaaagcccgtcatcactagtaattagagaaatacaaatcaaagtcacaatgagataccatctcctgccagttagtatggcgcacattaaaaagtcaggaaacaacccatgctgtaaaggatgtgaagaaatagaaacgctatacactgtttttgggagtgtaaattagttcaaccattgtggaagacagtgtggcaattcctcaaggatctaaaactagaaatcccatttgacctagtaatctcattactgggtatatagccaaaggattataaatcattctaccataaagacacgtgcacatttatgtatattgtggcactgttcacaatagcaaagacttggaacaaatccaaatgcccatcaatgatatactggataaagaaaatgtggcacatgtacaccatggaatactatgtagccataaaaaggataagtttatgtcttttgcaggtacatggatgaagctggaaaccatcattctcagcaaactaacacaagaacagaaaatcaaacaccgcatgttctcactcataagtgggagttgaacaatgagaacacatggaaacaggaaggggaacatgacacactggggactgtcgggagctgaggggctaggggagggacagcattaggataaatacctgattagatgatgagttgatgggtgcagaaaaccaccatggcacctatatgtcttttgtaacaaaactgaacgttctgcacatgtaccccagaacttaaaatatattaataaaaaatatatttatgtttctacatattgacaaatatgaataaattgttattaaaaattgtgcacaagattcttcctaaatatgttttcactgttcttgagaaaatgcctaggtataggatttctaagattttatgaagtcaaataaaaactctaggaaatcaccaaactgttttccaaattgtttttaccactttacatttccaccagcagtgttccgcatcttccagttgttccacatcttcactagaacttagtattgtaggggtttttttgttccctttaactttctaaagctgtgtaatggtaccacattaatctcattgtgattgtagcttgcatttttcaaatgacattgagtatcatttaatgtgcttattatatattgtcaaatgtcagttcaatattttgccaggttttaattggattatttttctcattattgagttttaaaagttatttacatattcctaataggcatcttgtattaagtatgcatttttcaaatattttctgggtcatttctttctcaacaatatcttttaaagaatgaatgttttaaattttgataaagatccatttatcaatattttttatgaattttaattttggtgtcatatttaagaattatttgcctaacataagatcacacaaatatttctgagtattttgtttctcgaagttatttaatgacatggtttggctctgcgtccccacccaaatctcatcttgtggctcgcataattcccacatgttgtgggagggacctggtgggagatgattgaatcctgggggctcgtctttccagtactgttctcctgaccatgaatgagctcaaaagatctgatggttttaaaaacaggagtttctctgcacaagctctctcttttcttgatgccatccatgtaagatgtgatttgatcctccttgccttctgccatgattgcgatgcctccccaaccatttggaattgtaagtccaataaacttctttcttatgcaaattgcccagtctctgacatgtctatcagcagtgtgaaaatgggctaatacatataattttctgttttatatttagatgtacaatttattctgatttaaatttttgtgtgttatagatcaagtccttttctttttgtctttcattcattactatttttatttttgcatatagatgaacatttctttcaccacaacttattggtgactgttctttagccactgatttgcctttgtgtctttttcaaattgatcgtacatgggtgagtgtattcctgatacattcatatttgtgtctgtccttttgctaaaacaatgctgtcttaattattaatattattcatattatgcctctttaataaatcacttaatgtgaatcttccaacttagttcttttaaaaaattgtttattccactttacttaaatgtgtatgtatccatcaacagagctttaaagtacgtcgtgtaaaatctgatacaattgaaagaagaaaccaacaaatgcacaattattcttaggaacctcagcactctcttttcagtaatttatagaacaaacaaatgaaatcagcaaagatatagaagacttaaaaaatactgtcaagtaacttgacctaattgacatttagagaacattccatcaaacaaaagcaatatctatctatctatctatctatcatctatctatctatctatcgtctatctatctatctatacacttttcaattgcatatggaacgttcaccaaatagaccacagtctgggacaagggtgttcaactataaaaaaaaatcattcaatgtgatccacataaaagcagactaagcaaggaaaacaacacataatcatatcaatatacaaagaaatgcatttgacaaactcaaaattcatgtatgattaaaaaaaattctccacaaacctagaaggtgatttccttaatatgaagaagaatatctatttaaaaatttacagctaacattatacctaatggagaactgctgaatgactacctctattggaaagactaagcaatgaaaatacacttttagtactcctattcaatattacagtgcttccagtcctagcaagtgcaagtaagtgcaataaggaaagaaaaaagattttaaaatgcatgcaaattgaaaaggaagaagtaaaaaaaaaatccccagtgatagactagatgatcatctatgaagaaaatctcaaaaaaatctacaaaaaagctctcagagttagtaagtgagtttagtacgtttgtggcataaaagtttgacataggaaatcaatcattattttatatattaataattaacaattgaaaaccaaaatactaatactaattatcatatttctttaaaaatgatatatgtaagtatgaatataacaaaacatatttaagatatatatatggtgatatggtttggctctgtgtccccacccaaatcttatgtggaattgtaatcccaaagtgtggagggagggaccaggtgagaggtgatttgatcatgggggcaattacttcagctgttctcatgataataagtgagatcttactagagctgatggttttaagtgtggcacttccttgctcttttcctctctctcctgctgccttgtaaagaaggtgtttgcttctccttcacattctgccatggttgtaagtttccagaggtttttccagtcatgcagaactgagagtcaattaaacttcttttatttataaattacccagtctcagatagtctcttcatagcagtgtgaaaatgaactaatacatatggtaaacattacaaaatgttaacaaaaaattaaggaagacctaaataaatggagagacataccacaggtatgaactggaaggctcattatagttaaaaagcaattttctataaattgatttctagatttaaggcagtttaaattaaaatattctcaggattctttttagatatcgacaattttattatgaaatgtgtacggaaagttaaaagcagtagaataggcaaaccaatttggataaagaacaaggttgaacgccttacactacttgacattacaaaatacaaaatttagcccaggaaaagttggacatgtagaccaatggaacaaagtacagttttacaaaatagcctgtacaaatatggccaacagatttttgaaaaaggtgtaaaggtaattaaataaaaatctttttgagaaatgattgtagaacaattgaatattcatgtgcaaaactgtaaatgttgatctacagctccttcttctccaaaaacatgttttaaatggatcatagatctaaatgcaaaacataaaactgaaaaaaaaatcttagaagaaaacatagaaggaactccttgatgagaggaggcagaataagatagcagaataagaggctccatcaatcatcctcccttcaaggacatcaagttaacaactatttacacagaaaaaaaaaaaacacctttatgagagccaaaagtcagatatgcacccatagtacctggttttaacttcatattgctgaaagaggcactgaagagatagaaaaaactgtcctgaatgccagcattactcacccaatgcccttcctctggaagtggtggcatggtgtgtagagcacccctggacaccagggaagggagaaaacaacaattgtgaggcattaaaaatgctattctgttagagctgaaagaaaaactggactaaactcagctgacacctgcacatggagggaccatttaaaccactcctagccagaggggaatcacaaattccagtggtccaaacttgagttcccacaaacctcaccacagagggctacagtgctctgtttctccatgtaaacctgaaaggcagtctaggccataggactgcaactattaggtgagtcctagtgctgaacggggcccagggacaatggactgaaggagcatgtgccatactgatacatcaagtggggtagtcaagagagttctggcatcacccttcccctaatcccaggctgcacagctcatggcttcaagacagaccctttccttttgcttgatgagaggaaagagtggggaggtctttgtcttgcatcttggatacagtctcagccacagcagaagggatgaagcacctgtttcaggccatagcatccaggtgacatttttagacacactcgggacaaaaagggaacccactgccatgaaaggaaggatgcagtcctggcagcattaattacctgctaacttaagagcccttgggccctgaataaccagcagtatacccaagtactatgttgagggacctgtgtgactcagcacattaccagctatggtggccgtggggcaaaactcctgcttaacaaaagcagagggaaaagtaaaggggactttgtcttgcaccttaggtaccagcatggccacgggggagacaagccccgagtaggcttttgaagtccctgatgacagaacttgacttctgcatggcatttctggacctgccctaagccagcgaggagaccactgctatcaagggtgagtcccataccaggcagaattcaccattcaccacaagctaacttaagaggaaatatcaatggtagtctgtcagtactccttgtggcttgcggtggaggtagctacagggtgaggcaactctgcctttggaatggagaggaaaaagtgggaaggattacttcttacggttttagtgccagctcagccatagtacaacagaacaccaggtagacttattaggtttttgactcgtccctgactcctggatgacacctctggacccacctcaggcctgggaaggcactgccctgaaggaaagaacacaggcctggctggctttgccagtagctgactgtagagccccaggcccttgagcaaatataggcagtagcaaaggagaggttacagcaggccttaggtgagacccagtgctgtgttggcttcaggtctgacccagaagagtcatagtggtggtggccacatgggtgcttgtgtcactccacccccagttttaggtgacttagaacagagagagaaaccctgtttgtttgtgagaaagtaaggaagagaacaagagtcttttcctgataatccagagaattctcccggttcttgtccaggaccatcaggtagtacctctacaagtctgcaagaaccacagtgttgctatgtttaaggtgtcccttaaagcagatacagcttacatcacaacacccaagtcctttcaaatatctgaaaagccttcccatgaaggatggctacaaataagcccagacaatgaagacaacaataaatacctaactattcaatgcccagacaccaaagagcatctactagcatcaacaccgtccaagaaaacatgacttaatcaaatgaacaaaataaggcaccagggaccaatcctagagaaacagagatatatgacctttcagacagataattcaaaatagttctgttgagtaaactcaaagaaattcaagatagcacagataaagtattcagaattctctcagaaaaatctaacaaagagattgaaataatttagaataaccacgcagaaattctgaaactgaaaattgcaaatggcatagtgataaatgcatcagagtctgttaatagcaaaattgatgaagcagaagaaagaattagtaagctgaaagacaggctatctgaaaatacacagtcaaaggagacaaaagaaaaagaataaaaaacaatgaagcacaccgacgggatctagataatggcctcaaaagggcaaatctaagagttattggcctcaaagcaggcatagagaaagaaataagggtagaaagcttattcaaaaggataatagcacagaacatctcaaccctagagaaagatatcaatatccaagtacaagaaggctctacaataccaagcagatttagcccaaagaagactaactcaaggcatttaataatcaaactcccaaaagtcaaggataaaaataagaattataaaagcaacaagacaaaggaaacaaataacctacaatagtgctccaataaatctggaagcagacatttcagtggcaaccttacaggccagcatagagtggtataacacatttaagtatgaaaggaaaaatgcttttactctagaacagcagattgagcgaaaatatccttcaaacatgaaggagaaataaaaactttcccagacacacaaaagctgaggaatttcattaacatcagacctgtcctacaaaaaatgctaaaaggagtactgagtacttcaatcagaaagacaaagacattaatgagccataagttatcacctgaaggcacaaaactcactggtaatcataagtacatagaaaaacacataatattataacccagtagcagtggggtgtaaaccactcttatcctaaagtataaaaactaaatggtgaaccaataaaaagaaaataactacaatgactttttaagacagcacaatatagtataaatagaaacaacaaatattaaaaaggagggagatgaagctaaggtgtagagattttggaggttatttttgcttgtttttttgcttgtttatgcaaacagtgttaagtttttatcaggtttaaatgatgtgttataagatagtatttgcaagccttatggtgacctcaaaacaaaaaagcatacaatgcatacacaaaaaataaaaagaaagaaactaaatcatatcaccagagaaaaatcatctttactaaaggaagacaagaaggaaagaaggaagtgatagcaataagaggtagaaaaatcctaggcagacagaggcaggtcctgggtgaaaccccaccttctagccaaagacagtttaaagcctgaaagccagggaccttcttcacaaggtggcaggaaggagaagggcagactgaagggggaagagccccttataaaactatcagatctcatgagaattcactctctatcatgagaagagcctggggaaaaccacccctatgatttaattacctccacctggcctctctcaacatgtgaggattatggagattataattcaagatgagatttggatgggaatgtacgaagcctaaccttatcattctgcccctgtcacacccaaacttcatgtctttttcacatttcaaaaccaactatgcctttctaacagtcccccaaagtcttaattcatcccagcattaaccaaaaagtccaagtccaagtctcttctgagacaaggcaagtcccttctacccatgagcctgtaaaataaaaaacaagttagttacttcctagatacaatgggggtacaggcattgggtaaatacacccattacaagtggaagaaattggccaaaatgcagggactataggctccatgcaagtcccaaatcaagcaggacagtcaaaccttaaagtttcaaaatgatctcatttgaatccatgtctcacattcaggtcacactgatgcaagatgtgtgctcccacagcctttgtcagtgccacacctgtggctttgcagggtacagcaccccttctggctgctttcaattgttggcatttattgtctgcggcttttccagccacacagtgcaagctgccagtggatctaccattctggcctctggaggacagtgacctcttctcataccttcactaggcagtgccctacaagggactgtgtagtggctcagaccccacatttcccttccacaatgcactagcagaagttcttcatgagggctccacccctgctgcaagcttctgcttggacatacaggcatttccatacatcctctgaaatctaggtggaggttcctaaccctcagttcctgacttctgtgtacccacaggctcaacactatgtgtaaaccaccaagacttagagcttgcaccctatgaagcaatggcctgagctctacactggccccttttagccacggctgggatgcaagccaccaaatccgaagactgcacaaagcagcaaggccctgggccaggaccatgaaaccattattttctcctaggcctccgggcctgtgataggaggggctgcagtgaagacctctgatatgccctaaagatatcttccccattgtcttggtgattcacatttggctcctctttgcttatgcaaatttctacagctgacttgaatttctcttcagaaaataggtttttcttttctgttgcatcatcaggctgcaaattttctaaacttttatgctctgcttcccttttaaacattagtttcaattccaaaccatctctttgttaatgcataaaactgaatgctttcaagagcacccaagctcttgaatgctttgctgcttagaaatttcttctgccagattccctaaattatctttcatgttcaaaactccacagatcactagggctgtggaaaaatgctaaagcataacaagagtcacctttattccagtccccaaaaagctcttcatctcctctgaaactaccttagcctggacttcattgtccatatcactatcagcattttggtcaaagccatgccccactaccttggtatcaatttactgtattagtttcttctcacattgctataaagaactgcctggaactgggtaatttataaagaaagaggtttaattgactcacagttcagcatggttggcaaggcctcaggaaacttagaattatggcaggaaggaaggagaagcaaaataccttcttcacaaggtggcaggaaggagaatgaatacaggaggaactaccaaacccttataaaaccatcagatcttgtgagaagtaactcaatatcatgagaacagcatggggaaaaccacccacatggtacaattacccccacctggtctctcccttgaaacacagggattatggggattacaattcaagatgagatttgggtgaggactcaaagcctaaccacatcaactcatatctcttggaatgcacagaagtctaatcaaagttaactaaagacttaaatctaagacctcaaactatgaaactattactagaaaacactgggacaaatctctaggacactggtttgggcaaagatttcttgagcaataccctacaagcacaggcaaccaaagcaaacatggacaaatggaatcatgccaagttaaaaaccttttgcacagcaaaggatacaatcaagaaagtgaaaggacaacccacagaatgcaagaaaatatttgcaaactacccatctgataagaggttaataatcagaatatacaaggagctcaaacaactctatagaaaaaaatatataatgaactgatcaaaacatgagcaaaagatttgaatagacctttatcaaaagaagacatacaaatggtaaactggcatattaaatggtgctcaatattgttgatcatcagagaaatgcaaatcaaaactacaatgagataccatatcacctcagttaaaatggcttatattcaaaacacaggcaataacaaatgctggccaggatgtggaggaaagggcactcttgtatattgttggtagaaatgtaaattattgtggagatgagtttgggggttcctaaataaaactaaaaatggagctactttatgacccagcaatccccactgctgagtatatacccaagagaaaggaaatcagtatatcaaatatatatctgcattcctatgtttgttgcagcactgttcacaacagctaagatttggaagcaacaacagatgaatacataaagaaaatgtggtgcttatacacaatggattactattcagtcattaaaaagaatgagaatctgtcatttggaacaacatggatggaactgcagattattatgttagattaaataagcaaggcatagaagaacaaacattacttgttctcactcatttgtgaaacctaaaaatcaaaacaagtgaactcatggacatagaaattaggagaattgttaccagaggctggaaacagtagtaggggactgggggagaggtggagattgttaatggatactaaaaaacagagttagaaagaatgaataagacctgctgtttgatagcataacagggtgactgtagtcaataataacttaattgtacatttttaaataacttaaagagtgtgactggattgtttataactcaaaggataaaagtttgaggggatggataccccattctccatgatgtacatatttcacactacatgcctgtatcaaacctttccatgtaccccataaatgtatatacctactaagtacccacaaactgtttttcaaaaattttaaaaagaaactccttggataatccatgaaagaaaaagatgataaactggatttgaaccaattaaaataatttgctctgttgtcaaaaagaggatgagaaaacagcccacatgccataagaaaacattttaaaatcatatatcttgtacccaaatgtaagaaatctcaaattttaacaataagtaaataaacacagtaaaaatatgttcaagagatttgaactgacatgatagcaaaggtgctatatgaatgacagtaaggcacatgaaaaggtgatcaacctcattattcattataaaaacgctaattacaacatctaataaaaacatactagaatggctaaaatccaaaaacaaaatgacagtagcaaaggctagtgggaatatgaaacaactggaactgtcatatgtcactggtagaaatataaatggtacagctactctgggacagtttggtgtttttgtacagttaaacatagacttactgtataacccagcaatcccacttatgttcacacaaaacctgctgcttacaatcaccccaaactggaaaccacccaaatgtttctctaagaattactggattaacaaattgcattatatccccatacaatgaaacattactgagcaagaaaaaggaacactctatttttacacaaaacaatttggatgagtcccaaatgctaagtgaaagaaggccatttctaaagtaacatactgtatgtttctacttacatgacattctgaaaaggtaaagctattaggaagagaaaacagattggttgttgccagtggttaggtttggtgggactgtctacctgcaaatggtagtatccaaggctccatagggtgttgggattgttctctatcttgttaggaaggctggttacaagaatatatgcttgcgttaaaactcgtaactctggatgctatcagaaaataaattttactttatgtaagttcaaatataataaatgatagcaatttgtgatattaaggtcatttaatttaaaaaataatatctaatcaacccaatattaagaaagtttaacattatgatcgcaaaattctaagtaatttaattgtactcaatgtgaattactttctcaaaggagcatgtgattgtaaaacctacctgtaagtttgcttgtaagatatcttatccatctctaatcagatgtcatggaagtggatgaatgtccctatcctttaaatgttctgctttaggaacagaaaaccaaataccacgtgctctcacttatcagtgggaactgaatgatgtgaacacatggacacgtggtgaggagaaacacacactgggacctctcagagggtggggctgcgggaggaagagcgtcaggaagaatagctaatgagtgctgggcttaacacctggatgatggggtgatctgtgcggcaaaccaccatggcacttgtttacctatgtgacaaacctgcacatcctgtacatgtacccctgaacttaaaataagaattggaaatttaaaaaaacaaaaagccaaaaatttctgctttaattaaatatcattatctttttataatgcaaagaaaaatgtgtcttaaattgtatttaagattacattgattttattcgacaccatcattcagtttacctgaaattcttatcctgaaaatatctgacataggtgactctacatataacaaaagaaaacaaatatcagtaactttacagattgtgccaaacttcttcctcaacgtaatggactgtgttatcagccattcaaagcatctacatctaaacgaagacatctagatgagtaacttctatgcatagcttcagttattcaattttgctcaaattacagtggactactagtgaattgtcactatagatattcataggcttcatataaaatattggccatgttcctatatgattctggttgctccagaggtcttggattcataattacctgagcgtttctaacatgtattaacatgaagcatcaattgtttctggtaaatgaggaataagtggtttttgttcagaattgctctctgtagattctctgctagtattataatcctctttgattgaggtaaaaataacctggatgactaaaggtaaatttttccacaaaggagaattaatgcactgtctgttttctgtagaattatgacagattttatgcctttgttaaatcctaagattagttggtataactactttcaatgctctggcctattttctttgttgctaaaatgaaaatagatcagaaacaccttttgaggcctctggatttataatttaagaattaactctgagaaagtagtaggtgaataaatagagttataatctaagacaacgttacattccttgtgtgagtctcacatctaagacccggcagtactttcttcctctgtgcattctcacgaatacccacacactgtaagcatagtttctaagattccataattatgaatcctaacaataagaatgactcagaatgcagaatattacaatgcagactctgtcctgtcaggtaaagtaaggaaaggtaaatactgcttaccgatacacattattaaatggtctgttctaatttctaattgtaacttcttggtttcaatattagacatacatagaaagttctgcctaagtaacttgaggctgattccctgtggcacaggtccttactaatagatggtggttttagaatttgcattaagtctttctatctagttcatttcaacaaatatttaccgaatatccactctagtcgaggcactgtgctaccatatgggaacataaagatgactaggacaatccctatcctgcaggagtgtacaattacaaagcagagatgtgttgattgttatgattaatataaagtatagcagggttccaaatgcatgaagctagactgaagcatggagaatatttaaaggagaaaaaccctgagtctacttggggagattaatcaagatttcaaggaagaggtaacattggaaagggtccactgagagggagtcagactttggtgggcacaaacccaaaatgaaggagatgggaacagtaagtgcttttgtttactgcatgcggattgatggtgagaagttaaccagtaaatcggagagcccagaccttaaatatctagtcaagtttgtgttccattaagacaataagtttgctgactaaagatttttgaaagaattagatgacattttcatgaaaaaatacactcatatggacatcagcatgcacatacatatgtatacatatttatacagagcatacatatatatttatatacatatagagtacatttcatttaaatgaaacgaaactacttggactgtggaggataaatttagagaaatctacacttggaatcacctgttacaatataaatataaaactttatggcatagatagtcatcagtgttatactcagaacattcaagtaaatatatgataattgtataatatcagggttatatgcttttatagtataatgcatataaatttatagtatgtagtatactagtaggctcaaaatatgactagtactggtgccattatttttgaaaattagctaaggcactaaaaaagataattcatgtgaactagactgataagctgaaaacattgctacttgttatttttatgtcaaatgtaatttgttttagaataaacattataattggctattcaatgcccacacacttagtataactttttaggtagaatcagtgattttatggtaacgtctaaccttgtggggaaaaatatttctctaaacttcagtttactgaaacttaaatttcacacagagtcattgactaaaaaagaaagtcaccaggaccttctcatccatctcataaattgctaatgcccacttctaatggtgcatttgcaattggtttggtctatgaatgacacacccataatcatataacttcctaataacattttgtggtttatactcctctaataattctctgtttaacaatggtcataatgattttcatacaatacagatacttaaataatattttgcatttttccagattatattttggcataagttaaacattatgttcattgtttatcttcaattaaaataacagacaaatctactaaagtgaaagacatggcaggaaggtaaagactctaaaagcacatgtttttaattgtgagaaataattttgtccatttctagaaaaaagataggaaaggtgattcttaagtatttaatgtacagataaatgattcattaataatttttacacaattatttaatttgaatggataaatattattaagaattgtcataagtatatatataagacatagtcttacatgctgtattagtccatttgtacactgcctaaagaactacctgagactgggtaatttatgaagaaaagagatttaattgactcatagttccacagccttaacaggaagcatgactggaaggccttaagaaacttacaatcatggtggaaggtgagagggaaggaaggaccttcttcacatggtgccaggagagagaggcagtgaaggggggaattatcacacacttttaaaccgtcatatctcatgagagctcactcactattatgagaacagcaagggggaaatttccccccatgatccaatctcctcccaccagtctcctcctccaattcaacatgagatttgggtgggggcacaaatccaaatagattattgtaagtataatgaaatataagtgccatttatttatttaaaaaccattttttgagaacatactatgtactagacatggtactgtaactcttgttctgaggattgtatgaaaattatcatgttaaaattcatatgacaaaagaatgggtctacctcaagaagggtatgggaagctataaaaagaatggatatttgatctggaatttaaagatcaggtagaagaagcttgtcttaatggaaatagagataagacatgagagagtgaaaaaagaaaataagcaaaaatagaagggagcttaaatgctatcccatttgttgtgggttgaattgtgttctcccccaaaatatgtcgaagtcttaaccccagtacctgtgaatgggaccttattgggcaataggatctttgaagatataattctgatgtaacttagtagatggagtcatgctggaggcccttaattcaatacacctcatgtgctaaaaaaaagagaagggacgagaagagacatatacagaaagaaaataacaccatggcagaatacagacacacacagagaaggaagacagccgtgtgactttggtggaagagatgtgagtgatggcaactgcaagccaaggaacacacaagattgttcaaaaccctcagaagctgggagagaggcatgaaacacattttccttcagaatccccaagttgcaaccaaacctgccgaaacctggatttcagacttttagcttctaaactgtgagagaataaatttctactgtttaaaccacccagtttgtgggaacttactacagcagtcccaagaaacttgcatactatgctgaataaatgaggtagagttgtcaaaaggtggaacaattagttataaaaacatatggagagaaatgagaaggaaagaaaaagtctaataaaactaggcattttgtgaataagctaaggagtcaaactcttagcatataataatatagagtttgtcttttaattcaaggcagttacattcttctatttttttttttattaaagagagcatgagtttcagagaagatgataattttgaaaggctaaaagctacagctatataggccagagaaaagacaatttcaattttctaatgagggataatgatagtttatgctatgtattgttacacatgtaatgccctctagagatgaacatgctacattggacccagcctaataaacgacctttgatgtcgttttcctatcaatggtgaagggtttcgccaatctatccagagtttcccttcttgtttctctgggggttaaggccctcattagaaagttagacagagagggtaataccttggtaatggcatgggcaatgtctttgatgaatacactcttaagagcaagataatttaagtgcacattacagaatattatggcaaacaataaagcttgcatagattgaaaaacagacctttccctcactgttattaactgggaaaactagctttgaattgtaattaattttggggttggatcagttataaaatgcatatcttataaactaaaggtttattttttcggacaagatacaacttccagtaacaggtgaatttgaataagtattaactaattttaaatagttatccaaaataacattatctagttagaatcagagggacacacacaggttgggaaatattttgcatttcttggtgcaattctatatttaatgatttttttctatgatctataataataagaacaattattgacattgtatttggtaaaaaatgcttgatttggattcgaagtttcattcttacaaaactgtatgttttggtgtcaaaatgataactcaatatacatcatattcttatatcactggaccactgtaaatgtataaaaagtctaggatatagttttctttaattttacagtttaaaaaataaatttctgagaaagtcatcacaattattgcaaataattgtatgattatgaaaaaaatggcagtagtcacaatgctacttgtaaacagaaagatacttggtcatgtgaaagatacttgtagtccactaggcacatataggccatacttcttcaatctaaaagacagaagaggcatctgagtaacagacatgtttcctttactcacctagcttcctttttctatcctttattgaattataataatagaataggtcttattatcaattaagtgatctttcttgttctcacaatgagagcagctgcatcaagtaagttttcgccttactaaaaactttcagatgtcttttggttttattattcaatttttgagatgtataattaaatccctgggaatgagtggatataatttagaaggcaattcagctctgtgaacttatacagatgtcactaaaatcatgtttgatggataatttcagaaacaatgaaagcatcattaactagagtaacttggaaaagcacaagtaaaagacactgttattttgacaatattgagttaaatagaggccacaggaaaaaaaaaaaaaaaaaacctgcacatcaaagttaaatgatcagcattcaatgtaagacattcttggagaactggaatgtttgctttggttttgttgaagtgattaacatgaatatgtcagctgcgtaattcagtgaacaaaattcatttcactgtaggaagtccatgtgggttaaaggaaaacaaaatctctttgtatgtccaaatggttttaaaaaggatctagggaacagttagtatggttcttactaattgttttctttctttaggtggaataaataattctaataaataaagggaataatcataagaatattctgaaaggaactaacagaaagctcagtgcaaaatgaaaaactataagcttacaataaactatgttttgtatatagatttataggtatataaaaggttagataaatagaacagcaatagagaacagagatagaaataaagattgattctaggtctataccatgtctttatttaatttaatataaaagaaaatcatcgatcaaagatgcaagaaattttttttaagaatccaaatgttgttagaattgactgtaataaaaatagtttgccatagggcttttcatggtacattaaaattaagaaaaatattttcccatttactagcaggtcaagttgcttcttttcagtgatcataatcaattatccaggaaaagggacagaagaaatcaggaaaaaggagaatagactctttatgcataggtaggttcagaattaacaaagttttgtggtggtggttctttgctttgacacagattcaatgtaataaaatttgtaccacctttaggcaaaattgagaccaatagaagaaaaatgtaacatagagtcttgaagttgtgtcaatagaagaatttaaaaacatatttgcttttaaaaattgttttatggccatataatttgcattcaataaagtgcacacatcctaaatgttcattttgatgagttatgataattttatacactcctgtaacaaacaccctaagtaagatatagaacatttgtatcaccctagaattacattatatgcctttctattcaatttccacctagaagtgggagctactttctgatttccaccaacacatatcagtttgttttgcatagtcctggattcttataaattgaatcatgtagtgtgtaatcttttgtgtgtctgacttttttcactcaacataatatcgttaagatccatgcatatggttgcatgtatcattaatttgttagtttattgctaaatagtacaccattataggaaaatatcaaaatgtattaatccattctcttgttgatagatattcgagttgtttctattttatctactgtaattaaggctgttataagcatttttatataacatgtttatggacgtatgttttatttttatttggataaagactctagaacacaattgagtgatcataacattagattgtatatatttaagtttaactgtataagaaattgccaaagtgttttccaatagtgttgtagtattttttgtcaccaccagcaatttttgagaatgcaagttgttctgtatgttaggcaacataatggcccccagagaagtcctaatcccaaaaacctatgaatttgttactttctatggcaaaaggagctttgaagatgggattagtttgaggatcttgagatgggaaagttattctggattatctgctgaatcgagtataatcacagggtatttgtaagatgaagacaagagagtcagcgtcaaagagatataataatggtggcagacacagaggggaaggagagaaagagaaagcagaagatgctctgctgctggctttgaaaatggtggaagaggccatgaactaaggagtgaatgtggcctccagaaggtagaaaaggcatgggaataggttatccctttagagccttcagaagaagcccagacctcccaacatcttgatttttaggacttttgaccacataacataatatttaaaagttgtgttgttttaagccactaagtttgtggaaatgtgtattagcagtaacagaaaactaatatgcatccttgccaacatttgctgtcgccaatctttttagttttagtcattctagtgggtgtgaaatggtttagcattatcattttaatttgcatttccttgatgacccatgatgttgagcaaattttcatactctatcaggccatttgtgtatcttttcctgtgaagaatttcttttcaaggctttgaccatcattctactgaattattgtttcttctgttgttgattatcaggagctttaatatatagttgacacttgaacaacatggatctgaactacacaagtccacttattggtggattttcttcagcctctgccacccttgagacaacaagaccaatacctcctctttttccttctcctcagcctactcaacttgaagatggtgagaatgaagacctttatgatcatccacttctacttgttgaatagtaaatatattttttccttatggttttcttaataacactttcttttctcttgattactttattgccagaatacagtacatagtacatataataagcaaagtatgtattagtttactgtttaagtgataggtaaggcttccactcaacagcaggcaacagccaggtgttgtgacacatgcctgtaatcctagcattttgggaggccgaggtggaggatcgcttgagcccaggagttcaagaccagcctaagtaacatagtgagacccccatctccacaaaaaattaaaatacctaatcatggtggtgcatgcctgcaatcccagctactcaggaacctacaataggagccaaaaaggtggaggttacaatgagccattattgcactactgcactgcactcctgcctgggagacagagtgagaccttgtctcaaaacactacaacaaacaacaacaacagcaacaaaaatcagtaggtattaatagttaggttttttgggagtcagaagttatacacagattttgactgtgcaggggatcagcgctcctaacgcctgcattcttcaagggttacctgtattcttgatacaagttctccttcagatttaagtattatagatatttttccagtctatagcttacctattcattttcttaataatgtcttttgattgatttttaatttttaactttggtgaattccagttgtatactttttttatgattagcatttttgtgtcctatgaaactgttgccttcctcaatgtcactaaattctcttaggttttcttctagcaagtttatgtttcaaattttcacccttaggtctataattcgtcccaaatttatttttgtctgtaaagcaatgtcacgattcattttttttctcaatataattacccagttgtttcaaaactggttattaaagtttttctcttaatcattgaattttcttggcaccaaattattaactcttgacaaaaataattgacccttaagtaagcagacagacaagcagtgcttctattttatagcaatgtaaataatacacaacttacacaaagactttttagaagctaactaacagtggtcctatctaagtacgtacaccagattttttataaccacttttaaaataaaagtatttagattttaacacatagattaggacagagaaagcatatggtggaataaactgtatctttttggccagatggtgctatttctaggtcatcttgataaagagaggaggcaaacatgaaaacttaatgaaaaactatttatgatgctggagagaacatcttggctttgagtcacttttaaatcatagaagaggattattccataaaattatttataatgcctaaaattattctttgcccaaatcataaattttcagcattaccaagaagccatttagtatgtatagggtgtttcagcaagtgcagagatgcccaggtggttgggattcaatacaacgagctgtcacgctgcacattcttggagtacaaccttaatgggcattttcccacctgtgcaattcctctgttttcaccccactccattcatatttcacaaactactctaattatagtatttattattgacctcaggaaaaagaagtttgaaagggtggaaaaaacatgcattttgtctccatggatagtaaatcactgagctattgttccttgggaatcccaattcatgagaaattacatagacttttgccctaacactaatcagctgcctgatctgtaaatatttcagatccttgcctgtatctatttctccttgcagaaaactgtaatttatctagatttttctaataattcactgacattttactgctatccaatgagtaaatcattgttgcttttggtatcttatgattttgttcttttgtgtcaaagtttagctagtttcatctatcaggttggaataaaaaatgcaaattatgactataccacttatatagttacatgatctactgaccaaagttaatcatcactttaatcttggtaactcattcagagccctaattgtaatagcctttgcctgagttacctagagagtggtctcaataatccccttttatttttcatgtagagaaaagggcacacaaaatgatattatctcgatcacccagcacatgtattaaactataacagactttttaaatcatgtgtgatcttttattttttgactgaaagggactaagtttgctgcccagagaagtctttagggagcaaggaaaggtaagcaaataaacttatctggagtcaaaggtctcaaggaaaatcttgctttctataaaaggcagacaacgtcaagactcatagattttcccagggctaaaaatcagagccaattgcctcccatcttgaaaagactcattcatcatgctggttgaagtatcacagatcttgtcaaaatattcatgactcacatacgacccatccaaaagacaaaagccaacaaaatattttaccaaattctaaaatagtgtttgttttattattctttgttattcttcaacaattattgttacctttactatatgaaatataatagcaattccttgtcttcatggtctttctgttacagacatgttttacactgattataccactttagtgaaattcatcatacatattcctgatccaaattccttttttattaaccatatatgagagaaagtggatattaaaataattttgatggtaaaataagcgaaaaaataaagcaagcatggttaaaatgattaaattatggaaaagtgacccatgtgtttcagataaactgacgcttgagggtttttgttgttattgtggtttaaattttattttattttaattttaagttccaggatacaagtgcaggatgtgcaggtttcttacataggtaaagatgtgccgaaatggtggtttgctgcacctctcaacctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaattagatttacatgcagtcaagttttcttttgatgacacactctcttgatatatactaagttttatacttggaatctttcacttttatccttactcagaaacgtgaatattaagaatcagtagagccagctcttctacatgttccctgccaattgctatcttgcctacttttaaaacacctctaacttgagaaaatgaaaacccacaaactaacaattgttccagggaagtccatggcatcacttggaacttttcatcattagtcccagttacactcttttgtgttgtatacaacattggcatatactctagtcatctgtatgccaagttaaatgagacttcattcagcaaccagtaatatgtcatgcatcagaagtctctctcatcatattgcttatcaccatcaaatagtttccattttgtctttattccttaaaaattgtcatgcttaaaattggtgcaaataatgtagatacttgtgattctattatatctacatatatttttctattttgcaagagaagtgaattttaataaattagttctcttagattataatgctacagaaaaactgaatgacctgactcgttggtgatttgattgggactggatttgtgttcctgcccaaatctcgtgttgaaatgtaatccccaatgctggagatgggaactgatgtgaggtgattggatcatgggagtggtttctaatagtttaacaccatccccgaagtgctgtttcgtgatagagttctctgaagatctggttgtttaaaaatatgtgtacctcccatctgtctcttcctcctgctctggccaggtaagatttgcctgctttctcttcaccttcaccttccactgaagagagaggttaaagattaacccccccactctaatcacatgtactgtctataaatctcaatctatcaagaccctttcacgtggaccccttggagttgtaagcccttaaaagggtctggagctctttctttggagagcgtcattcttgagatgcaagtctgctgacgctcccagccaaataaagcctcttccttctttaacatggcatctgaggggttttgtctgtggctcatcctgctgcatttcttggttccctgaccaggaagtgaggtgattaacggacagttgaggcagccccttaggtgacttacacctgccctgcagagcatccctgcagtgaactccagccagcttgagcgatggggatcctgagaccgctcctgggtaggtgtttgtcctggtagaactcctcgtcagagtggtgcatggcaggcccccgcagatgatcaatgcaatgtctgaacactgggaaggaaccattgcttggagtccagacatctggaatacagaaggaccggtcctgggaacttgcccactgcatttgagtggaagcgtggcctgatcacccactgtgtgcccttatgggcactttggtctcagtattgattttgatttggcttgacctgtttgcaaaaaggaaagtgaaagtgagtgagtgcttgagttttagatgtgcgaggtgagcgagtgacctctttaccctttccttcttgtggtgtgagtgttgttttgtctcgggaggaaaatgggtgttatgcaaagtaagcccactctgctaggaactatgttgaaaaatttcaaggaaggatttaatggagactatggagttactatacaccaggaaaacttaggactttgtgtgaaatagactggccagcattggaagtgggttgggcatcagaaggaaacctagatgggtcccttgtttttaaatgtatggcacaaagtaactggtaagccaagacacccagaccagtttccgtaaatagacacttggttacagctggttttagagccaccacagtggttaagaggacaggcagcagtagtactagtggcaaagggacagacagccaaggaagaatcctgctccaccaacctaagggagtcagctcctaaagtcctgtctgatccaacaccagaggattcatggcaagaaacagcaccagtggccccctttccaccaagaagaaaggtctcccactccgataccccatcctataccaaaaagccacaagctctgatggatttgctccaaactgttatccagacccacaaaccccacctgggctgattgccactagttgctcatatgcctctttaacacagatgaaaggaggagagtgctccaagcagcaacgaagtggctttagaacatgttccagctgattaccaaaacccccaagagtatatgaggatccaattaccaggaacagatgccgagtgggacccaaatgaaagacagggtatgcaaaggctaaaccggtacaggaaagcccttctggaagggttaaagaagggagctcagaaggtcacaaatgttaacaaagtctctgaggccattcaaggaaaagatgagagcccggcacaattctacaagagactacgtgaggcctatcgtatgtataccccctttgatcccagtagccttgaaaatcagcacatgattaacatggctttagttagtcaaagtgcagaagacattaaagaaaatttcaaaaacaggctgggttcacggtcatgaatacttcacagttactggagatagccaagcaggtgtttgtgaatagagacacggtaagctacagagagaactgcagagagagtgaacgccaagcccggcgaaacgccgacctgctagccacagctataagaggggcccccccaaagagaccagagaaggggggccccaggaaaaatacccagtctgtccatccacgcttgcagcgtaatcagtgtgcttactgtaaggaaataggacgttggaaggacaagtgcccacagttgaaagggaaacaaggtgactctgagcagaaggcctcagacaaggatgaaggggccttgttcaatcgggcagaagggttactggactgagggggaccaggctcatgtgcccccaaagagcccattgtcaggatgacagtcgggtacgaggacatttagtttcttgtcaatattggtgctgaacattcagtagtaaccaccccagtcgcccccttatccaaaaagactattgacataatcggagccacaggggtttcggcaaagcaaacgttctgtttcccccagacctgcactgtgtggggcatgaagtgattcatcagttcctgtacatggctgactgccccttgcctttgctaggaacggacctacttagcaagctgagagccaccatcacttttacaaagcacggctctttaccgctaaagctacctggaacgggagtcataatggcccttatggttccctgggaggaggaatggagactcttcttaactgagccaggccaagagataggagcaactctggctaagtgttggccaaaggtgtgggtggaagacaacgctctagggttggcaatcaaccaggcccccgtactcatagaagttaagcctggggcccagccagtcagacaaaaacagtacctggtccccagagaagctcttgaaggtatctggatccatctcgagtgcctgagggcctttggaattgtagtcccttgtcagtctccatggaacaatcccctcctgcctgttcccaagccaggggccatggactgcaggctggcacaggatttgcgcttggtcaaccaagctacagtgactttgcacccagtggtacctaacctgtacacattgttggggttgctgccagctgaggacagctggttcacttgcctggacctaaaggacattttctttagcatcaggctagctcctgagagccagaaactgtttgcctttcagtgggaggatccggagtcaggtgtcaccactcagtaccttggacccagcttccccaagggttcaagaactcccccaccatctttgggggggtgctggcttgagacctccagaagtttcccaccagagacctaggctgcttgctgctcgagtacatcgatgacctcctgttgggacaccccacggcagtcgggtgtgccaagggaacggataccctactccagcacctggaggactgtgggtataaggtgcccaagaagaaagctcagatctgcagacagcaggtaagttacctgggatttactatctgatagggggagcacagcctgggatcagaaagaaagcaggtcatttgcaacctaccggagcccgagaccagaaggcaggtgagagaattcttaggagccatggggttctgcaggttatggatcccaaactttgcagtactggccaagcccctgtacagagtcacaaaggggagcgacaaggaacctttcaaatgggggtcccaaaagcaatgagcttttcatgagttaaaagagaaactcatgtcagcccccgccctggggctgcctgacctgacaaagccatttacactatatgtgtcagagagagagaagacggtggttggagttttgacccagatcatgtggctctggccaatgctggtggcctacatctctaaacaactagatggggtttctaaaggttggcccccatgtttgagggccttggctgcaactgccaatggacggatccagttatcagataaaaaaatagccatgccacaactgctaggagccacagtcgtactggctgttcttgaggccccacatgctgtggtgactttaatgaataccaaaggacatcattggctaacaaatgctagactaactaggtaccaaagcttactctatgaaaatccccacataaccattgacgtttgcaacaccttgaaccccaccaccttactcctggtatcagagagcccagttgaacctaactgtgtagagttgttggactcagtttattctagcaggcccgacctccaagaccattcttggaaatcagtagactgggagctgtatatgaacgggagcagcttcgtcaacccacagggagagagatgtgcaggatatgcagtggtaatgctgggcactgtcattgaagccaaatcattgcccagggtacttcagcccagaaggccaaactcattgctttaatttgggccatagagctaagtgaagataagactgtaaatatttatactgactcttggtatgccttcttaaccctgcaagtgcatggggcattgtataaagaaaaaggcctgttgaactctgggggaaaagacacaaagtatcagcaagagattctgcaattattagaggcagtgtgaaagccccaaaaggtggcagtcatgtactgcagaggacaccaacaatctttcaccttgattgccttggggaactcccgagctgactcagaggcttgaaaagcagcatccaccccctaccgggcatcagtcacagcaccccctgctccttcaggcacctgaccttgtacctacttattctaaagaagagaaggactttctccaggcagagggagggcaggtgatagaagagggatggatccagttatcagatagaagaatagccatgccacaactgctaggagctgcagtcgtactggctgttcatgagaccacccacctaggccaagagtcacttgaaaagttgttaggctggtagttctacaactcacatccggcagcccttgccaaaacagtggtgtatcagtgtgtcacctgctggcagcagaaaggtaggcaaaatgcaaatgtcccgcccagcatacaagcctgtggagcagacccctttgaagatctccaagtagacttcaccaagatgcccaaatgtggaggtaacaagtatttgctagttctagtgtgtacatactctgggggtggtggtggtggtggtgtggaggtctgtccaacacgaactgagaaaactcttgaagtaacctgtgtgattctccgagatctcatccctaggtttggactgcccttacaaatagactcggacaacaggctggcatttgtggctgacttggtacagaagacagcaaaggtattggggatcacatggaaactacataccacttaccgaccacagagttctggaaaagtggagcagatgaatcagactatcaaaagtaatttagggaaagtgtgtcaagaaacaggattaaagtgggtacaagctttccctatggtattgtttaagattagatgtaccccttctaaaagaacaggatattccccttatgaactattatatcataggctccctcccatactacggggattcccaggcactcctcaagagctaggtgaaattgagttacagtgacagctacaggctttaaggaaaattacacaaacaatttcagcctgggtaaatgagaggtgccccatcagcttattctccccagttcaccctttctccttaggtgatcgggtgtggatcaaggattggaacgtaacccccttgcagccattgtggaaaggaccccagaccgtcatcttgaccacagccacaaaggtagagggaatcccagcctggatccaccacagccatataaaacctacagcacctgagacctgggaggtaagaccaagccaggacaacccctgcaaagtgatgctgaagaagacaataagccctgctcctgttacacccagaagctggctggtccatgcctggctgaagcataaggaaactcattgtgggtctcattttccttaaattttagacttgtacagtaagtacttcaactgatcttcctcagactgaggactgttcccagtgacatcaagttactgaggtagggcgaaaagttaaaacagtctttctgttttataattattatgaaggtactggaactctaaaagggacttgtttgtataatgccacccagtacaaggtatgcatgccaggaagtgaccagcctgatgtgtgctataacccatctgagccccctatgactacagttttccaaataagattgaggactggcaactggggaaaagctgataagagtaaagtaatatctaaaacagaagagaaaggagttcccaaacaaattatcttaaaatttgatgcctgtgtggcaatcaacagtgacccgtatggaaatagaataagatgcggctgtctagattgggaaagtggctatatagtagaaaataagtatgtttgcaatgaattaggactgtatagtgatgaacatagttactggtcctgtgtcatttaggctacctggaaaaaagataagaaggaccctgtcctccttcaaaaaggaaagagtaactgttcctgcactagtggtcactgtaactcattagaactacctgatcaccattggaaaacaggagagtatgtaaccctaggaatcaatggaactggactggatccccaagtaaatatttaagtgcaaaggaaggtccacaggctctttcccaaaccagtgtttcagaccttttaataataatagtgttaggagcctgcatgttactcccctgtatgttacccatatttctaccaccttagttcatcaaaagacctcagcacaagtgtattacatgaatccctattgatctgtctcacaggaagacctgggtggtgactatgaaagtgagaactcccactagtgagtgaggttctcaaagtgggggaatgaggagagaggccatttatcttactgtctcctgtctctgaagagaaagaggaagtaaaagctgaaaaacaacaggaatgaaatcagtggcaagaccagccagtgcaccgatgaccaggcctgaggttaaaagattaacccccaactctaaccacatgtgctacctatagatctcaatctatcatgaccctttcacgtggaaccccttagagttgtaagcccttaaaagggccaggaaccctttcttcggggagctccattcttgaaatgcaagtcggccaatagtccagtccgaataaggcctcttccttctttaatctggtatctgaggggttttgtctgcagttcatcctgctacagtcccagtgctggtggccacaggagtgcttatgtcgcccctcccctaaatgcagacagcacagcatggagagagagagagactccatttgtttgggggagagtgaaggaaaagaacaagagcctctgcctcataatccagggaattctgccagatcttactgcagaccaccaaggtggtacatctgtgagtttgcaagagtcatagtgttactgggcttgagatgcctctaaagcagatatggctgcagtgaccaaatacttagatcacaaccctcaattccctttgaatactgggaaagccttctcaaggaggatgggaggctgggcatggtggctcatgcctgcaatcccagcactttaggaggccaaggtgggcagatcacctgaggtggggagttcaagaccagcctgaccaacatggagaaaccccgtctctactaaaaatacaaaattggccaggcgtggtggcacatgcctgtaatcccagctacttaggaggctgaggcaggagaatcacctgaacctgggaggtggaggttgcagtgagccgagattgtgtcattgcactccaacctgggcaacaagagtgaaattccatgaggaagaagaaggagaaggagaccagatgtggtggctcatggctataattccaacaatttgggaagctgaggagggaggatcacttgaatccatgagatcaaaaccagcctgggcaacatactgagatcctgtgtctacaaaaaatacaaaaatcagctgggcatggtggcatgtgcctgtagtcccagctacttgggaggctgaggtgagaggatcgcttgagcccaggaggctgaggcctgcagtgagccatgatcatgccattgcactccagcctgagtggcagagtgagattctgtattagaagaaagaaacaaacaaagaaagatgggtacacacaagcacagactgtggagattataataaataactaattctttaatggccagacattgaccaatagccacaagcatcaagagcatccaggaaaacatgacctcacaaaattaaataaggcatgagtgtccaatctcagagtgacagaaatatgtgatctttcagagaaaaaattcaaaatagctgctttgaggaagctcaatgaaactcaagacaacacagagaaggaattcagaatcctatcaaatatatttaacaaagagattgaaataattttttaaaatcaagcagaaattctcgacctgaaaaatgtaattgacatactgaagaatgcatcagatctcttaccagcagaactgatcaagcagaagaaagaattagtgaggttaaagacaggctatttgaaaatacacagtcagaaaagacaaaataaaaaagaattaaaaactataaatcaagaaataaagtaaaataaaaacaatgaagcacacttactagatctagaaaatagcctcaaaagaacaaatctaagcattacaggaggtagagagagagatcagcatagaaaatctattcaaagggatagtaagagagaactttccaaacctagagaatgatatcaatgttcaactgcaagaaggttatagaacaccaagtagatttaacccaaaggagactacctcaaaggcacttaataatcaaactcccaagagtcaaggatgaagaaagaattctgaaggaagaaagagaaaagaaaccaataacatgtaaggagatccagtatatcttgcagcagacttttcagtggaaacattataggccaagagagagtggcatgacatatttaaagaattgaaggaaaaaaaactttcattctagaacattatatccagtgaaaatattctgagatcaggagtttgagaacagcctgaccatcatggtgaaatgctgtgtctagtaaaaatacaaaaattaactagttattgtggtgtatgctgttaatcccagctactcgggaggctgaggcaagagaatcacttgaacccagaaggtggaggttgcagtgagctgagatcacgccactgcactccagcctgggtgacagagtgagactgccacaaaaacataataatagtaataataaaagaaaaaggcaaaaattcaaacaacagaaactgggcaaagccctccacaaaagaggaaatgtgaaggaatagctaataaaaacacgaagagggtctcagcctaacagggggagatgtcacgtgacacccaccagactggcaaaaatcccacaacccaatccatgcaagagttagggagaatggagagtagcaggaacaccaggcactgctaagaacggttgtgaaatatatttttgttatgcttctatatgaaagggtgtgtgttgtgggttatgagaaaaattacatttcttacctgggatgaaattttaaacattggaagctattgaccagaagaaacttgcacttttgtacaaaagaaatacccaagaacattcctaacaaaacagagtcctaaaggccccaacctggccaaacactcatcaacagggaaatgaagacatttcccatgctcctctcatatgaccggagatcatgcagcaataaaaatgaatcatgtcaatgtgggtgggtctcaggaagagaatggaggacaaaaatagacatcgagcagatgctcagagccatgcagtgtaggagcagccacacaggagaatttctcacatcaaagttcaaaactacagccaaggcaacagagcaagaccctgtctcaaaaagacaatggaaagttccaaaactaaatggcatattttttagggatgtacacataagtggtggaagaaatgtactatgaagaaaaatatgggaataataaagactaaaagaggaattgattccctctgtaggagaagggaaggggctagggctcaggcagggcctccggggagcatccaaagttatgtctcttcagattctattccctaaacttggtggaggtcctctgtgtccaatgtgtctgtattctttataccttacccatattgtacaaatgctttatttctattcaacatttagaagacaatcataaacaaaatgcattaaatagcaagatggcaaatgaacctcaggaaggaacatcaggaacatccatgaggttccatccacggaacctcaccatggatacgcttgtgatcaagggccttgtctcccctcaagacagtcagagatcagaggctgccctcatcatagcagtggaacaggaccagctgggacagggtccttctgtgacacctgctgtgtcaccaggctgtgcgaatggactcagctgcccgaactcacagaatatcagtaacagcaccgaaacttcacaggaaaaatggtaagttgtaagtttctccattaatagtaactctcagattagtctatgtcatccatcgcttctccattaaataactttttatagctttacatgggtcgatttttcaatttatattttattttactaactgaatgaaaagatatatattgtgtgtggtgtgtgattttgtctcagtcaggataatcatagtttaatttctattattattataccaatatcatttagtttttttaagctgttcaattcctgagggtattaatcagggtctttctgtctcatgagacaaaaaacaaatccaaactgtgtaagagaaagaagaatgcattgatcacgaggactgagaagctcccaggcttaacttgcttgggattcagctacatgtacagtttcaagtggtgtcctgtaaactctctctctctctctctctctctctctctctctctacttccccaacatctgctccatgtttagctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagcaccatctcctcctggggtctcaagctccaggaccctcagacttgaatcgcagcaccagctcttccccggatctccagcttgacgaccttcagacttaaacaacaaaagaatcagctcctccctgggtctccagcaccacaacccacaaactagaagaacaccactcccccatggatctccagatccatgaccctcacactagaacaccaacacctgctcctccgtgggtctccagatccacgaacctcacactggaacaccaacactggctcctctgcgggtcttcagctccacaacctaagacatcagtggcagcattggctcctcccatggattccagctccaagaccctcacatttaaactgcaagaccaccttctccctgtatctccagctgcacaaccctcaaactagaacatcagctcctccaatggtcttcagctgcacgaaactcaaactagaaaaacaacagctcctccctgggtctccagctctgcaaccatcaaactagaacaccatcagctcctctccaggtctccagctccacagctctcaaataagagcaacatcagcttctccctgggtctccagctgcacaaccctcaaactagaaaaacaccagctcctgcctgggtctccaagctccatgaccctcaaactcgaacaacatcagctcctccccacgtctccagctgcatgaccctcaatctagaaaaacagcagcaaactaataaaacctccccgggtgtttctagtttgagggtcatgcagctggacacctgggaaggagctgattttaatctagtttgagcatcgtggagctggacactcagggaggagcagatgtttttctattgtgaggattttggagctggagatccagggtggagcagtgttgttatagtttgaggtcatctgagggtcagctgcatgacccttaagccagaaaaacaccattttccccctgggactccagctccacaaacctcacactaaaacagcaacaccggctccttcgcaggtctccagctttacaacctaagacattcgtggcagcaccatctcctcctggggtctcaagctccaggaccctcagacttgaaccgcagcaccagctcttccccggatctccagctcgatgaccttcagacttaaacaacagaaggatcgactcctccctgggtctccagcaccacgaccctcaactagaacaccatgagctcctccctgggtctccagcaccacaacccaaaaactagaagaacgtcactcccccatggatctccagatccacaccctcacactagaacaccaacaccggctcctctgtgggtcttctgctgcacaatctaagacatcagtggcagcattgactcctcccatagattccagctccaggaccctcagatttgaaccacaagaccacctccttcttggatctccagctgcacaacactcaaactagaacaacatcagctccaccccgggtctccagctccattacactcaaattagaacaacatcagctcctctttgagtctccagctgaaagatcgtaaaacaaggacaacatcagctccttcccgagtcttcagctgcagggcactcaaactagaaccctcccccgtcttcagctgcacgaccttcagactagaacatcagcaactctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccctcaaactagaacattagctccttcccgagtcttcagctgcaccaccctcaacctagaacatcggctcctctctgggtctctagctgctggacactcatactagaaaaacacaagctcctcccaggttctactgttgcacgaccctcaaactaaaaaacaaccgctcctcctcaggtctccaggtgcatgaacctcaaaccagaacaacatcagctcatccccgggtcttaagctcatggccctcaaactagaacatcagctcctccctgagtcttaagctgcacaaccctcaattgaaagcatcagctcttctccaggtcttcagctgcaggacactcacactagaaaaatgcaagctcctcatgggttctacagctgtatgaccctcaaactaaagaaacaccagctcctctctgggtctccagctccatgaccctcaaactagaaccaaatcagctcctctttgcatctccagtcgcatggctctcaaactagaacatcagctcctctcctggtctccagctgtaggacactcatactagaaaaacgccagctcttccccggttctacagctgcatgaatctcaaactaaagaaacacccgctcctctccatgtctccagctgcatgaacctcaaatcagaacaacaccagctcctctctgggtctccagctccatgacccttaaactagaaccacatcagctcctctctgggtctccagctgaaagaccctcaacaagaacaacatcagctcccctccaagtcttcagctgcacaaccctcaaactagaacaacatcagctcctctccaggtctccagctgcaggacactcatactagaaaaacaccagctcctcccgggttctacagctgcatgaccctcaaactaaaaaacacccgctgctccccaggtcttcagctacatgaacctcaatctagaacaatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcctccccagatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgagtaaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttcttaacccggtgtctgagtggttttgtctgtggctagtcctcctacaccaccatgattctaactttcctgaggttttctcagaagccactatgcttctcatacagtctgcagaaccttcagccaattaatcttcttttccctataaactacccagtctcaggtatttaatagcagtgaaagaatggactaatacttgattattccagctaaacaaaatcaaagtagacaccatgccattgttagcaaattcaggctaaatcaccaaccaaaaatatgtgtgaatgtctcttgcaatatgtgtaatgcatctttgtgtaatatgcatatttgaatacaatttatatttatgttttctgaagagataaaatcattgggattcttttacattcagaatccatgaaggtccttgaactagaaggtatgattaatttcaaaataaatttgaaaattagttcataagtcaatggcaaaattaacataggtgggaattaatgttataatttcatatactgctttcataatttagcagtttttcatactgggaaaattataaataataataggaaatatattaatataacaaattgtatacttctggcccaatttcttcttcttttctgagaatatataattactatttgatatagattttttatgttagccatagacaatccttaattgaaaaatcatttagacaatctctcaaactttaagttaattttctatgccacattttcttaactcatcaaaatatgcattatattgattttcaattaatttattttgaaatgaatgaaataaaaatgtgaaaaaagttatccaaaatgaaacaacagtataggatgattaacaagattaacatattagtcaatataaaattccactgctatattgccatagctatggaactgttgtgatatgttcattctactaaatcctaatatttaaaaaaaaaaaaaagaaaaatgacctccagtacatatagaaaattggttgctttagtatgcattaactaattttgaagaaatagcaaagaaatgttcaaactttctttgttttattaaaacaatgctgtattgtgttagactattgaaaaacaaaacgaatagggacctgtattctttgaactgatgagcttcttgaaaatagaataaataaccctggcattggacttttaatatggtattgtttaaaggagcacttttggctagcaaaattagaaaggattttttattttttcatcctctatatatgctgttcctttctccagaagacaagccaatggtatgtgaaagagctttaaatttttcactcaaaataatcacgtagagataaaaaagaaccgaccttctattatatcaccggtctaagagaaacgtgcgttttaacttcaccctcaacagagtaagctcttgtggccttagtgcttatcatgcattttcagtagggaaagaaaatcacaatgaagaacaaaacattttcaacttttaaaaactaaaagagggaaaatttaaggcagaactaaattaagtagcaataaattagggctggtttagttggtggtttccaataagctctacagccacttccttcaccaagtacatgagtgttgcttcagcaatcattcctttaattcatgtcctttctctctctagaaaaactcatatattcattatcctaggagtatcaggtttgcaaagctggaccaaactaaagactcttcgaggtgcactttggcttcttaaaagagctaccaagattttggctgaggcatgtgacttaaaactcagcaggtatgattggcaagctatcctgtgaaacttgtaatcaatcaccatcggttttagtgaattgtattatctttgttcttgtaaacactttctttcaagttatcattgcttgtgattgaatcatgagctcttagatttctaagggaacagaaaacctatgaaacatttgaagcacttttgaaaagaaacttcgtggccagaaactcaccaaaacctgaggaaatcttttttattttgaaataaaagaatgcttcctttgtgtttctgtccttgaatccagttgttttacttgagattatagcaaagtcttctctgtcttttatataatgattctttaatatttgacctattcctcttcccccacctcatttatgagttatgtctattccatcttaaacattctcaggttcttaactgtatctgctactgtaaatggtagtttagtttttgttattttgattttttttgtttattttggtttttttctagctttattgctgtataattgacaaatagaaattgtgtgctacgagttgatgtgtagctattcatatatgttctgaaatggttatcacaatcaagttaattaacatatctattactttatgtagttaactctgtgtgtgtgtgagtgtgtgtgtgtgtaatgagaatatttaacacctaccctattggcaattatctccctattttcctttcccccaaccccacccttctactctgtgctgctataaatttgactattttagatttcacatgtaagtgagattatgcagtgtttttttcctctgttggattatttagcttagtatcatttccttctggttcatacttgttattacaaatggcaggatttccttctttttcaaggctgaaaaatactccaatatatttgtgtgtgtgtgtgcatgcacgtagaatccttcatggagtcatttatccattcctccattaacatttaggtttccctgaattggctattgtgactaatgctgcaatacacatcggggtggaggtatctctttgaggtagtgattttatttcatttggatatacatccagaaatgaaactgctacattttatgagttctaattttattttttgaggaatttccatactgctttccacgttgactgtattaacttacattcccaccaatagtttacttgggttttcttttctccacatctttgctaacacttgttatcttttatctttttgttaatagccattctaagaaatgtgaggtgataactccttgtggatttgatttacatttccctaatgcttagtgatatgaaacatttgtttcctatacctgttggccatttgtatgtcttctttggagatatgtttagtcaggtcctttgcccatattttaatagggtttttcatttttttcactatggagttgtatgtgttccttatatattttagatatgaaccccttatttgatgttttgaaaatattttctcccatttttcaggtgtgtttttatcctattcattgttttgtttgatgttcagaagcttcttagtttgatgtagccccactagtctatttttgcttttgtagcctgtgtatttggtgtcatataaaaaaaattgccaagaccaatgtcaaggacatttttttctatgatttattttactagttttacagtttcatgttttatatttgcatatttaatctgttttgaggtagtttttgttcagtatatggtataaaataaggtttcagtttcactcttttgcatgcggatattcagatttcccaacatattttattgaaaacaatattccttccccactgtgtattcttggcacccatgtcaaagattagttgagcatataggtgtgaatttatttatgggttctctattctgttccattggtctgtgtgtctgcttttatgccagtacaatactgttttgattactatagttatgtaatacagtttgaaaccatgaagtaggatgcctccagcatttttttccttgctcaagattggtttgactattcaggatttcttatgtttcagtataaattttggtttccaaatccaaatactgtttaatatagtgaacaaatctttgttttctttctgaaaccatctttccaatatatctcagaagtcagtggtcttaatgaattggtgccaccatctttccttgctactcaaatatgtgttacataaatttgaaaattatttgaaagaaaatggccaaatatatctccttcatatttctccttcatgtgtttttttatcctgaaaataaaactgcaagagggaaaaaacaaggaacaagcaacaataaagaaaaaaaaagaagtagagactaggtaactaagagcaagataaaaaggtgagttttttcactggaggattggatgaaagaactaattaatttgtctctcagtttgagcttttcaagagttctttataagtccttcatactgtgacatgatctgttagccattttcactgtggtccccattctagaagcattttactctctctctctctctctcttttttttcttttttggcgggaatgggggatgggagtaggggaatggagcctcactctgtagccaggctggagtgcagttgctgatctcagcttactgcaagctccacctcctgggttcaagcgattctcctgcctcagcctaccgagtagctgggactacaggcacgtgccaccactcccagctagtttttgtatttttagtagagatggggttttaccatgttggcaggatggtctccatctcttgacctcatgatccgccctcattggcctcccaaagtgctgggattacaggcgtgagccaccgcgcctggcagcattttactctctttcacatactttcttatatttatccttagttttttgaaaatataagagtgacattataaggaaaacttaaattgtgagtagctcctagtagaaatggcctcctacttgacttttctctcctgttttgcctcaaatcattcttcctggttaattgagtatgatttctaacatgaagaaacttgacttctggctattagcaaaaaacggaaattttttctctattgttatattatcatatggcttcagctcatggcaacacattttcactttagtcaattctaacagcatttggatttagcagtgaaattgtttgcatctttcattgataattttttccaaagcagtgtaaaataaaatgtggttttgatctggaatcactttttcctacatgcacatgcacacccacccacacacacattattaggtgctcacatccttacaatggcacaaacaactttgcactgaaccctttactagtcacttacacttctcttgacttgaatattctgcttatttatcagtgtaatggtttttatccaaataaagtaaaacaatagaattcaggccaattagcctttatatccttgttgaaaatatttaatattacaaataattttgtttttatttagtcctctttaaatttgtctttcactgtataagacaggcaatatattcatgtttatcatgtcaaaaaactgaatcaaatgttaaagtgctttaagaaagcaacagtatgaaagctgatcaagcccactgtggtctgcatcttctttatatgatatactgcctttcagaattttggagatgttattaaaaaatcaaatttttgaggtcattgatggcatagcatgtattacattctttatctcttcagttactagaactaaaacactagatcgattttatatgtatgtatgaattgataatctcaaatttttacatttttaatttaaatatttacatgtttaaattttcatctcttttctgctttttttcccaaaatatattgtgttccttagttctatgtttatatttaggaatgaataattgaacaaactaatttaggcagcttgagtggatgtcctcttcacatacttgcctctaccccagaacatgagaagtaactgtcagtaattattggcaagtattagttttcagagatgtgagcaaggaatggacatgccctatctccagcctacgtgtatcctcaattaaaaatgatttggattctgttccatgtctccatgcccactcttggatccccaattttgggcagacagatcgatcaatttctttagaatatattaatctggactcagcatgaaagaaaataccccattgcaaatatggcttggaaggcagaatagtttatctaatttatatacccatcttctcaaatctgagatctctgtaaataccaacttccaaggactcttttgtgaagagcagctttctccttcactgactcctttttctgctaagtctatgagcatttcagttcattcctaaatgtgatatcatttgccttcctactgcaaggaatgtctttgtctcctggtatcttccttttctcctattcttaatagatttatgaattattctctattttaatgtcttgtggttacgggaatctcatggaagttgacacatttctcaatatgtgttatatgttggatcccatcacattgctcaatttgcatttcataattgtgtctttggtacttgttcatcttcattgtgttcctagcaagcaaaaccatccccttagcctaacatcactgtaacataaataagcactcccctagtttctatgcatccccaaaataaattcagcttcatgtaaatatgactattgataaagatgtccacttattgaatacacttatcaaaagatttttctggtgtaacatggatataatttctgtcttaagaactctaattctaaagaaacctgtgtatggatttcacctttaggccttagtttaaacttatttaaatttgtcttcatagatcttaccctctcaagctattctgttttatgacaaagaccaacactaaggttttttatatttatatatgtgaactgaaataacgttctaaaatattttaaatcctacaaattagtttctttcattaaacagaatcctttctttgtgttggacattaattcagtgttaatgtgaatataattgtcatggattaatattaaatatttgccaatatctccctttacaacaggattttttattaaagtgtgtggatgtctttttttctttataatgtcttaaaaagaagaaaactttggtcatactataaaagttgagtctgataatgttttattatctgggaaaccatttaaaaatagtttcattgttattaaaatgacatctgggttacatgtgaataattattaaaataattatagaacaacatgcatttgtgaggaataatacaaagagattctgtatacactttgcccagcttcccccaatgacaatattttgttaaactatagtgtaatatcatgacaataatattgacattttacagtccgtccaacttactcaggttaccccagtttggcttggactcatttgtgtgtgtatgtgcacatgtacatgtataaattctatagatttttattaatgtgtaggtttatgtatctaccatcacagtcaagacactgagaagttccatcaccacaggaattccctatgctaccgtttgacaaccatgagaaagcatttttaatatatctatttttacatttgggaagggtcaaaagtcctttcattagcccagctcctgtccagataatttaaattaatgatgtctgtgttcttgtatggatggcatcactgcttgaaatatagatctccagggtgctcctgctctcactctttctgagccatgatctattgcatgtctgtacatcatcaaagcaaattgcttcttcaatgatgtgtaagtataatacatcatcacaatgggacatggtgataatgcattacccagaaaaagatgactgtcatatttgacagacaaggtcaaggagcaaattcaggcagccccagcacatttcatcagcagcattcttggtatagaagaaagtttgtttgcttagaatgatccacttgaaatgtggacaaggctaaatacatacgtatgccctgggttgattcctttggtaaattaaaaacgaggtggttgagcttccattaaaatgacatctggatgacatgtgaatagtttttctgtccacagggtgttttgaatcatgtgtgtttcttactcattcagcatcaaattgttttccagagaaagctcttcaacaagattgcaaagtccttcagggtagtaactgtcttatacatcctttgtttctttcacagtgtctaaagcattgctgagcacatggaagacactcaataaatactcgtttaatggaattgaatttgtaagcaccagagactcatgcttccttttcacatagcttgacacttggctgcccaggatccttgcatgcaaggtggtaaggttactgtgggaaaattctgttggcttactatcccatttgctgtctgctctttctttgtttcttcctcctttttttttttttttttttttttttttgtagagtctttcagccaggagctatttttataaagaatttcattttttgctcatgaggattaaacttttaagtttggcttcagggtgtgagagaagtacaacttatgaaggttgctctgcactgcaaaaaggataggatttgaggaagggatgtttctgacattggcacagcagtattccgttctcccccatcccccagttgctgccaaattggcctttctttaaagcatacagtatttatttctctagtccttggatcatagcaattttatttcaatgtcaccagtgaaggagagaaaggcaatattttgtccaagagtgggatttgaaaatgagtcctctgaggatatgttagagcaacctaagtattagatgctggaaaaatggatcatttcttgatatttcggtaggacacatctccatttcaaatatatgcatgctacaatgcagtgaatacatagtgcattttagtcagctctaaaagtaaccaagccaaattttatacaattgatacagacaatgggtgttcaagtgggaatacatgttactggctctctgccggcatgatgaaatagaggaggcaaatagatacagctcacgtgccaattctggttgctcagtcacagttatatcaatatcatgttgataaaagttataaatcagggatcaatttgcaacatctaccaggggcccaagtagaaacatgtggtatgcatgacagttatgaatcaaccctggtggaggaaaaagatggagagtcatggaccatacgcctaacaaagtaattgtacctggtccaattttggaccatgagtaaaccatttaataaaaatatatcatagaattgttttgagattacattttaagttgcataagctataatgtttgttatgattatgctaattgtatatatcattagagaaaataatcactaaatattttgaaacaaaagaaacaatgaatttaagtaataaatataatcccactcagccagagacgacaagttattgatactcttgtagatacatttattatataaaaacaaatatattatgtgatttatattttatcttacatattattttaatatcgatatttttctctcataatacacctttaatatatttcaatttcaaaagataatttctgaaaaactgtttttatatttgcatggtagttaattatatggctatacataatttttttaaacaaacacctatatttttacattgaagaaggatctaaattttgtatatgaatcatactcatattaaatatttttgcaataaaaatgtttctacttctttagtaaaatcccaaaggctgatatattggatcaaatgttctacagatttaatgggatttattcagtacttaaaaggaattgtattaaattaaactgcacaaagtctgtgccaaattatgcacctgcaaacaaatgtatctgattagaaggcagtgcagtaagttcttttaaaaggcttgttttttaaaaaatgaattagctccaaaactatttatatattaaggaacaatttgagcatgacacaaatttcttgtttgcctatgtgttacctcatctttgagaaacactaggcggatgcacaaaatggcacctggcagaacaaagccatgtagcaatacataaaatgtaagcataaacaaacctcaaacatccaacagctacttcagctcagcacaggtgtgatgagaccacccatctatatctggtgttacagctttctgtctgatttcagataattcttatttcaccactttgcaattcctcccaagctgaaaccctttcaatactcacttccacaagcaaaccttagtttttcttcaaaaaggaagtgtcatatttcttttatgaaactatatatttctttaccacttaatatggataaaagtatgctactatttttattaggttcctatgattttcttctgtgtatgtcactgaaaaagtttttgactattgtttcccaacaccagtctccccataagccatgtaatttttttttcataaatttgcatcgcaaggtgaattttaggaatacatcatataacggagctgattctttatgtgtgtatactttctgaaagattccctatgtgagataagaaaaataaaaagcgttttccttgctctcatattcaattcaaatttatgaaccagatgtattggttccccgtgacacacaacaagcagctaattctctaacagataccaactgggtatactataacttagctcaattttgacactatctacctagaattattatcagatgctacaggttaagcactcagtctcataggactaacctcaatttaaaatgccaattgcaagcctggggttttgacctgtgcttctgagtgattggctataaatctgagttcccatcaccccttcctcagattcagctaatttgctagagaagctcaaagaacttagggaaacactttacttagtttacccattcactataaaatacattacaaagaatatagatgaacaagacagatgaacaggtgcatttttaaaagagccagggcaacgtatgaaagctatttacccaccctcccaggcacctccagggaaccccgacttttggattttttatagaggcaacattacatagacgccattgattatatcatttgtccttggtgatcaactcaaacatcactccctctctcttccctggagggttggggtggggctgacaactccaactctaattatgccttggtccttctggtgaccagcccagtcctgaagctatctaagggtcccaaaccaccaatcatctcattaatatgcaaagacacatcactctagaaattccaagggttttcagagctgtgtgacaggaaccagggtcagagagcaaatggatagttcttattatatcataatatcacactccaataagtcaacacttgcctcattcaagactgattctaataaagaatgataactattatttttcactacttaaagagtcagacctatgtggaagttgcactaaatccagttacaatttattccaccacgaagcttggaagctctatgacccttaatacaatgttaatgtgaaagttttatattgtctgcaaaccaaaaactatctgagactggtctcaattaatttagacatttattttgccaaagttaaggacagtgcttgggagacaagactgtgtctttctccaaagatgattttgagggcttcaatatttaaaggggaaagggcaaatgctggagagagagaaagacatttttaaaagctgtgggtagttaagaggcaagcagttgcattcttctgagtctttgatcagccattcacatgtgacagtagggtagaaaaatcgtcacttatgcattcatctagctcagtgaatctacattttttacataaaataaaataaacttaaggctgaagaagcaatcagataagcatttacctcagatgagcgaagtgaagactttgagttctgtcctttgtcctgtatttgtgaagacaagctatcaatgtacatggtcagggtaaaattcaacataactgtctcaggataaagatcttggggcccacaaggaatttgctcttgggaaaattatgagggagctatgtagctttttcatgtttttagccatcttagaaacaaaatgggaggcaggttgcatgacgcagttcccagtttaaattttccttttgactgagggagtttggaatcctgagatttattttcctttcacatattttgctcaatttattcatgaactgtgattttattcaaaattattttattttcaaattcattgcattcaaataatcataaaatgtgtacctgcattaaatgaggcagtgttgttctttttcttccttcatttacaaaagcttttttccacttttttcattgaataaaaaagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatggagtcctgaaacaagtggcacaatgcaatgctgaaagaaaaggccttttaattgagcatcctagacccagtgaaaatgtcctcccagattgaaggggaaatcaagccattctcagatgagaaaacattaatttgttattatcaaacctaccataaataatggctaaagaaatttgttctctaaacaaaggaaatgacgttccaaaaatcttggaacatctgaaagaaagaaacaatacagtaagcaaaacttttgtaaatacagtaggatttgttgagttttctaaaatatgtttgatggtagaagaaaaaattataactttgatgtggttctaaatgcatgcagaggaaattttttttttttttttgagatggagtctcactctgtcacacaggctggagtgcagtggcaggatctcggctcactgcaagctccgcctcccgggtttacaccattctcctgcctcagcctcccgagtagctgacactacaggtgcccaccaccacgcccagctaatgttttgtatttttagtagagatggggtttcaccatgttagtcaggatggtctcgacctcctgaccttgtgatccacctgccttggcctcacaaagtgctgggattacaggcaggagccactgttactcagtaatgcgatggctgggtcaaatggtattatttctagttctagatccctgaggaatcgccacactgacttccacaatggttgaactagcttaccgtcccaccaacagtgtaaaagtgttcctattgttgtttcctgacctaccgtctggcactccccagtgagatgaactcggtacctcagttggaaatgcagaaatcacctgtcttctgtgtcactcacactgggagctgtagaccagagctcttcctcttcggccatcttggctcctcctcaatattagaattttctatccttttttgtgactcatttttctctctgtgttaactacattctcttcaactacaagcaatttcctccacgtggctgaaaaaggtgactgcagtcaggtctatatcgtagtggtcatttattctaagaacacttatggtttgtaaggtcaagttagtgacttgattgtatatgaagtagagtcaaccccacacaaattacatgaaatgagagcgaggggatttttccaaagatgagaacaatggacatgcttcatgtctatttgtgtcttcagtcagtcagttttcagcatgtaatgtacattcccttcagagaaaacaaatgaactaacattttaaagactggactatggagaaaataaaagctaatacccaacctatttgtttttacatttggatttctccccattcatatgttgaataggaaatttcacgtttcttaaatagatttttaaaaagtatttaaaatacgatttcctcaaatctttgcacgtattttttctggttcattttgtttcacatgctagagaaaaataaataccagctacaaatatgaagcagaaattgtctattgagcattggtatcaaattttctactgagaacactgaaaacattatctcatttaaatatatatattagagtcttaggatggtcataacaaagtaccatagaccgagtggcttaaaacaacagaaatgctgttggatcactgttctggaagcctgaagtccaagttcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgactcgagttgctgacagggcaatggtccctctggtgtatatagaggaaccttccttgcctcttcatagcttttggcagttttctgcacacctttgctgtcccttgaagctgcaaaatccagcctcttcgttgccacattgttccttccttgtgtgtatattggtcttctcatggccacttcttacaaagacaccagtcgcattggattaggaaccgtccttactctggtatgacctcatatttaccacttacatccacaacaaccttttctacaaataaggtcacactttgtaatactgaaggttaggaaacactgggtgtttggacttcagtatatctttttgttgttgttggggggatacaattcaactgataatactgtggggctaatataactcacattttacagatgaagaaatttgtgcatattgagtcatttacatagtatcacaagtaacagagccaggatttaaacagattccatctaccactgaaaaaccacacacagaccagttattcacctcactacttcctgcagccgataactgttttccattgcctgaatagggtataactgccaaaaataagaacaagaaaaatgtatgaaacaagaggactttcatagcaaaagagacagccactgtatagaacccagcacactgcatttttcagaacaaaataatagatattttaaaatgaatttgttagccaaatagaaagtaaagtctggggcaaatatctctaccacatagataatccactgatgacttacagttcagttggacatataaaatatgatagaacttttcaataattatccttaaactctagaagaactttgaggagtccttgttcatattgcttttctgaatataattaataagattattaagatcagtctgcagcagtttccttgtagatggaaaagttaattctcagttcagggtataaacgagaaagaacataattactattattggactaattttcctaataaagttaggcttgctagcccttagtacaccattgttaatttatacacatgttgatgaaaggcaagataagtaaagtctagtgagtttggaatagtttagaggtccccctcaacttttaggtatgtgaaggggatttttaatgaatgcttttaagttaacaaggaaaagaagggactgaatgatcagttttttgtattaggtggtctgtttcccactggaaaagttgttatgtggctaaagagcctggtttaaataaaaacaaacagacaaatttatgcagaaagttaacgaagactaaaaaccccagtgcccattgtgctgggacagcagatgccatcagcagatgcactggagtttactccagttctttactgagcccaactatataatggctatgcacatttaaatactttaaacacaaaacaggtaataaacacgagtggattgaaacaatgggcaacatgtgtggatatgagaaagtggagcgtgtgagaaaaagtcttttagagctaaagtgcaagcctcttctaaagccattaaaatcctttttgttttttctttttgagatggagtcttggctgtcactcaggctggagtgcagtagtgtgatcttggctcactgcaagctccgcctcccaggtacaagtgattctcctgcctcagcctcccgagtagctggaactacaggtgtgtgccactacgcccagctaattttttgtatttttagtagagatggggtttcaccgtgttagccaggatggtctcgatctcttgacctcgtgatctgcctgcctaggcctcccaaagtgctcggattacaggcatgagccaccgtgcccggctaaaatccatttcttacccctaacatgctgtgctagaaataaaaaagcaactctgaggccctaatcagattccgtagtctaccaattcgatctgtcatcttcagaactctacactaaacttctccaacatataatcacagaaacaacacaatagttacaacagcatgaatgttttctatatcatttcaagtcttccacaccataaagtcactaagaataggaaattcatatttacttatacttgcccattctcatttctaatagaaaaataatatagcaaaatgatttgaatgcctacactttcacaatactcactgacttatttgtaatatgaaacaaaacaaataaaaactaacctagtgacccattcatatatgcatgctttctaaaaggttttgtttttgtttttaatgattctcatttgcttaccacatcagtgttgcaatgttagtcatctggaattctagaaattgggggaaggaaaaattagaacacctaccaagttaagctaatagaatagtattttgtaatagaaacctaaaggtacatagaagatagatacggttttatcaaaataaactaccaaaactatactaaggatagggatggagaaaggaacgaaatcaagctttcaaatgactctggagagggtggttggaaaaggctgaaaatcattcagtaacatttctgaacatatatattcatacagaggaaataaagaaagtaaccctctaagataaaagaagctaggagtgttaactgctataaatatgtgaagagaaagaaacatcaagaaaagaagaatttttaaaaatttcgtggactgggaggagaaagggagttgatatttaaaaagacattaggtccatggagggtgccctccagatgttcccaagtcttgggcattcagactctaatcctttgtatgatgcataggaataaattagccagcctcttgttacccacagtgtgatttgtaaagcatcagcttcaaggttatcctggagcttgatagaaatagagacctggcggtgtcactccctgcttaacaaatgagaatccacattttcagaagaccccaggtgattcctatgcacatcaaactgtgaagagcactgagccagactacagagtgcaaagccctgttctaagccacagtgatgctgactctcctcaccattttctctctcaaggtcctgactgtgggcaaaatatagaatcttagagcctggattatagcagttttacacaagcagcacactgatggaagcagctacagaggaaaagagaactggcagctcttgaactttcaccctctttcagaattcttaaaaattcagagagctgttctttaaagagacatttttctctcagcagttgaatctttgtagtctgacttgtgagaggacgtcaaagacttcctctcaggagtcagttccctgccattgcacccagctccttgcctagccttcttccacatctcctttatcacaggggcctcaaaactatagatggcagtgacttggcacggaccatacaattctaaaaggaagtcaacttagtgttatacttccacatggaatctgcgtttctaaagtagaggatagcattgaatataccaagaagtttcttcccagaaacaaaaccccgttctggatatagtgttaagaggaagctgttcctgtttcatgaggtcgtaatactcagatcggtgtgctgtcatcagccctgttgaatacatttccaaatcctttaggcttttgtcttttgccatactctagaaagtaaaaactataatcaaactcattttcttcgcccctttacgtgaattaatgttataatcaattgaactgcatggacatgccagtatctattttcaatctgtgtaggcagaatgaagaaagcataattgagcggtgctcatcttttaaaggcaaaatgaagttttcagtttggaattgattagttgttaggggattaagacctttgaggtaattccctgcagctggggcagttagacggcaggggatttgagtttccgccttgtaaacaaatctttaaagtggatttgctatttctgtggggaggggagcctctgtggaatttggtagttggcaagatttggcaattttctgcttgggaagaaaacaagatgggtctcaaatctaagtcctctttttctcagatcaacatcaccttttgaaaaataaattgattctttggccttaatgactactaaaggaaattaaaaacaaacaaacaaaacagaagaaaaatgattaaagaagccgggcgcagtggctcacgcctgtaatcccagcactttgggaggccgaggcgggcagatcacctgaggtcaggagtttgagatcagcctgaccaacatggtgaaacctcgtctctactaaaagtacaaaaattagttgggcatggtggcgcatgcctgtaatcccagctactcgggaggctgaggcaggagaattgcttgaacccggggggtggaagttgtggtgagccaagatcttgccattgcactccagcctgggcaacaagagtgaaactctgtctcaaaaacaaaaaaaaacaaaaaaaaaaaggaaaaatgattaaagtaagaatgaaaatttagttaatgttatttaggacagtaaaagcagatgtagtcacagaaagacaatgtgcagatgattatatggaaagaagaatgtgaaaccttcagatctctttaaaattttataatagctttgtattttcaaataaattgcaaagagtttctatacttgtatctagtttcccctattaacattgtacattagtgttgtgtagtgttttaattaatgaaacaatagtgataccattgattacgatttcatgaagtctgtagttcatttagagtcctttagtttttaagaagtgtcctttctctgttccaggatctcatccaggataccacattacatttagcagtcatgtctctttagtcgtctctttactgtgagtatttctcacacttctcttgtttttgatgattttgacagtttggatgagaattggttaggtattttgtaatctacacatcaactgaggcttgattgatgtttttctttaaaatatttttcccatttgtatacatgtgtggtatacaagtgcaattttgttacatgcatatattgcacagtggttaactcagggctttagggtatccatcacttaaatgatgtacagtgtacattgaagtaatttctcatttacccccccaaccccctcacccttgtgggtctccattgtctattatccactctacatccatgtctacacgttttataacacccacttatgagcaagaacatgcaatatttgactttttgtgcctggtgatgttttccttttgattaaactgggacacacatttatgggaggaagaccagacagataaagtggcattcttatcacatcatctcaagggcatacgccattgacatgacttattgctgttgatgttgaccatggacactgggctgaagtagtgtttttcaggtatgccactgtgaaattatattcccctgtttacaatactgtatactttagacataggttattatgtacaacccacacttaaaaagtggggagttatcttccacctccttgagggagtgaagtagtatctacataaattatttcatattcttatacaaagggtatttgtttatttcatttatttatatacttgtcttgatacaatgtaaatgaatcactacttatttatattattataaacatataaatatctatagtatagtttgggttacaatccaatacttattttgttactcacattgttcttgctttgaccactgggagatctttcagttggttcttgtaatacaccatttttaaaagcaaaatggagctaagtgtggtggcgcatgcctgtagtcctagatactagggaggctaaggtgagaggatcgcctgagcccagaaatttgagactgctttgagagctatgatcacatcactgcactccaatctgggtgatagagcaagaccctgccccagctaaaatgaaaacaaaaaacaataacaatgctacatgggaagtgagcatgacaatgtggtattttataattatatccaaagattagtaagcatgattcatggagaagtggctaaatctaagcattgttttcccatgagattgctgttggaaaagcaatagaaaaaaaaaaacaaaaaacaaagaattgagtgagtcaagagataggaagtctttcagttaccttagagtcacgttaggtatgtagagaagcagttcagattaacaaagttcaaaagatcccaccgtcagatctgtataacaagctttgcacacgaaagagctagagtatctgtgactctgatgtaagaaggtattaacccagtggaaaataaaaacaaaattaaaaatgcctaggtagactcatttatggttttatagtatccctactggggcacagatgggaagggagaaactgtttttaaataaaatgatcagaaacttagactgtgacattaatttgttggttcagtgttttaatttggaggtaaattatactaaacagtattatgacattttctgtagaaagtcttctacgtgtattgagtcactgcctgttatattggtttaatcagcaagtcatttttgctgaatctcttagtctccactaatattgtcttgaaggtgtaaatggcatgcaggttgcctaaataaagctacaacattctgtaaggcattttgtgaatgaactacttttgcagatggtacaggtgttcacccctgtaaactcacaattattttagaagtgatgtacaggttgtcagttgtccccatctgcctcattccccacatgcattgtcacctttgtgtcaatccagatctcattagctctttgtagacaaagatagaatggtagataatatataagtaaatgtggctgtgtttttgctcttcaagagaatgcacaagagactcactcttaattcttactatttcatgtatgtgcagcctcttaatgcttactatttcatgtgtgtgcagcttcttaatgcttactatttcatgtgtgtgcagcctctacaactacagtgcatctctattgtttgtacagtgacaataatggtaagaataataacttagtacataccatactgcagaaactgtttaaattacatccaatgtgcccatttaatcatcactttaaaatagtaactcctactcagtagcaatgtgcagtttatagatatctttcacatttgaagatatgaatctcagtgtacatatattggtatgcaaaaaaatcagttatatacatgtttagaccacttatattttaatcccaccaagcatatggaaagcttaaccttatgggtgtgtgtgtgtgtgggtgtgtgtgtgcaggggttctctaaacttaaaacctgttgtggatgcacatgaaattatatacagtgccaagaaggggcacaggccctgctcagtgagtcatctgactgcacgagttaatagatataacgtgaagggtcacagttctctatttgggtttttttgtacagcctctgtttctctgtctctacaaagcacgtagcctttttttcaagtctcgatgcctctttcacagctcagccctgggcctgctatcctgttttcactgcttcccttcttttttctacatgactttttattttactttaagttctgggatacatgtgcagaacatgcaggtttgttacataggtatacatgtgcaatggtgatttcctgcatccatcaacccatcatctatgttttaaggcccgcatgccttaggtatttgtcctaatgctctctctccccttgttccccaaccctccagcgggccccagtgtatgatgttcccctccctatatccatgtgctctcattgttcaaccaccacttatgagtgagaagatgcggtgtttggttttctattcttgtgttagtttgctgagaatgatggcttccagcttcatccatgtccctgaaaagggtatgaactcattctttttatggctgcttagtattccacctacatgcctatttctgagtcaagcacgttgtttatgcccagtgcattttctttatacacagaggctgagaaagaaccaggaagcctctgactgtttcaagtgtgttctctgctatatctatctactgattcaataagcacaagctcattgaatggaaaagggcaatatgcaaagggagcaaaatgagacatatatgtcaaaggaaagttccactgcaaatgtctttatttgatgtacacagagggatttgaattaggtctaggttttatgcccactttacagaaaaattgaaacttgatcaaacctatagaaccagtaaatgtcaggaccagacctggagacacactcccctcggtgcatattttatatcttcttcattttatcaccccaaatcatttactcctgaagtaaattcatttaatatttaacaaatgtttacaaaagttgactatagtaaaagtattatgttagctgctatgaagtagaaatataatcacacgattatcttaatgaagcatctctactttatagaagggaaattgagattctgaatcattaaggttttaagtgtcatcacagggattgttagtgatagaatacagagttgagtctagggcttattaaactgtatctgtcactctattcgtgtattagtctgttctcatgctgctaataaagacctacccaagaatgagtaatttataaaggaaagaggtttaatggactcatggttccacatggctggggaggcctcataatcatggcagaaggcaagggagaagcaaagtcacatcttacatggcagcaggcaagagagcacatgcaggggaactaccttttataaaaccatcagatcttgtgaggcttatccactatcacaagaaaagcataggaaaaacccaaccccatgattcaattacctctcactgggtccctcccacgacatgaaggaattatgggagctacaattcaagatgagatttgggtgaggacacagccaaaccatatcaattggcctatttcagtttgagaacatacatctgaatttcaaggaaatttgactacaattgaagaaattgagtatcattactgatttctaatggatgttgctgtatgtaatattttctatatgagagacaagatgtaaggatgaagatgagggacaagttcttcatctagaaagatcaagggtgctgtcaaggaagagttgaatttgattcagaactgaagaatatttgggctttcaactagctcagagaaattctgtagtcactagaagatccttgcatttgagagggcaaatttgaatatgttccacaagtaaaatcagaaattgggctttttattttactaaccagattaatgctctattccagaaatgcaaataggttgtacttttattttaacatggggctacttttgcctactgttttgctggtttttgttgttttattgcaaaaccacaattactgttacacaatggaagctccatcagtgaagatactttatctactttcttcactgttatattatggggtaaaaaagtgctttgcgtatgagaacaagtaataatgaaactggttacttttggcagagtctgcgttatacataggctcttttgtgaagatctaaatatggttatgtaatcagttgttcagacaagagaaacgtagattaattgaattagataatcccagtggtctctcaaagatcaaacaataaaacaaactattatcgtaccccatttgaagtacttttgtataacaacagcgttttaacatgtttatttggattaagattatcagcgactttggaagtcaattaagtgtgaaagcgaaacatggtatttgacgacagtaccagccctgtattgctgcaaatacattctataatagcactggacgcatcattcagattttatgacaagatgcaataaccagctacctgtgatgataaaatagacttttttcaaataagatttctagcaacctttactatgcatgttttctttgttgtcttgtaacattaaccatggacatcacatggcaagcatgatgaagagaatttctttagaatcgagttttataacaaagaatgtattccaaagtaaggatttatgttggtggataattatgagccaggccgactactatgaataacttacatcagggctagggttggagaaaatgaggagagagtagtacaattaaatgatcaatcataactagtctatttgtttatacaataatgaaaaatagtagtttctattggactgaaatgtttcaggtaaaattgatgttatatcaaattaattaaataataaatgtaattgccttaaatcaatgcatgcttaggattaatactgattaaaaatctaaggatgcaaaaagatttataacaaaatgacagtaacagtggtctttcctcaatctctttttctcccaaaagcaaaatctgtttataattttaatttttatgagagctacttatataaaaatgtagacaagaagaaattattttttctacttgtgcatctgaaagtatcttttcttttctttccttccttcctttcttccttccttccttcttctttccctccctccctcattcctttcttccttcccgcctttcttccttccttctttccctcttttctctttcacttccttcttctcttatcactcctcccaaatttaaaatcatctgtccattgtctttgtcatccagtatagataataaggaatctgatggtcttctcattaatagtgaacttgctgtttttctctcaaaaatgagaaagcttttgggagcttctttttatcttaagtgttctgaaatttcaagacagtatgcctgggttctttttaaattccttttgctggatactcaggtttcaaatcagaaggtttatgtccttcttcatttctgcaaaattatcttcaattatttcttgtactatctattcttcatctgtgttcttactgagataccgaatcatctgaatttgttccttttttgtatttttttctttcttcatattttataagaattattcagctttattttaaagtcctatttttattctctaagtgactattcttgtatttaactttttatagcatggtctacattttaatggttgtcatatatttttgaatgtttatttacagagcatcacttttaaaattgttttctttccataaattgggtctgtttgttttggaacaagcttttccatgtatttttctttttcactctctttagtgatctccagctgtcaattcatgttgtagaaggacagtgatgttggtcacagattccccaaatgctaaggttaggtgagaaccagcatactcatcaaagatcttcattttccccaaagacaaaatgcagtgcttttagaaaaaaattaattacttttgggatgttatttccctcatgataaacatggttgccatttacactctctactgctttgagagagaaatttctgtcaagctgtgaaattggtccacacacagcacttcaattaatttcagtttttgaccctcattgtcttctcaaaacgatcagcaccttctcaatctgaagtcacaggatggcagaggttctgcttagcagactctcccactttgaattgcagtgttttgttttacctctttcatctattttccaatttttagaaatttgttgactttttttgtaaactttttttgcatttgcacttctacatttatttatattattacttttacttctgtgggatctcagtaatgaaggaaacatatatgcctaggttaccatattgaattcaacatagagagtatgattttttaagtaaatcctgaaagaaaactttctataaatctacaaatcctcttgaaattttctttttatatttatttgcaaatttttaatttcttgtatttcgtaaactgagaattttagatacttttacatttgtagcatcaaaaataattttttaaaatgatgacatacttagagtcaatctattgggattgagtgtatttttaaaattagaattgttaaaatagtatttgacatttgctttgcttctggtactggtaggctagtttgctgcagaccaactttcacaccaaaaatctctagaaaaaaagacacaaacttcttatctcaaaatatccatgtttcagcagaggttagctgagttttgctgtattcagggtgtcattgggactgcgatctcgtctgaagcttgaggtcctctcctacacatgttcaggttatcgttccttgtggctacaggactgaccaaagttgtttcctttctggctcttggccggaggatatgtcaagcttctaaattatgctcacaatcccatgccaagtgtcctccatcataggacttctcacaacatagaagactgctttgtcttcaagacgagcagaagagcatctttctcacattaaatctgacttatcttgtccctaacctcttgacagcatttaataaaagctaaattcgttagatcagactcacactgacctaaacataagattaataaggatcagctttctattggttaatttaaagtcaagtgagtaagatgctaattacatctgtaaaccgctttgctatataaaataacaatcttggcagtaatatcccctcatattcacagtttcctcttacactcaaggggagatgattatgcagggtttatgcacatggaaccagacatcttgggagtcatcttagaattctgcctaccatgaagtctacataaccaaaaccaggagaaagaaaaagaaaaaaatatatagttcatgggaaatccagatattggggttatcttaagtaatttcgaaataaatatttaatatgttaagtattttaaatgttttaaatattcaaaaaattagatggccatggaaatgttcattagagaacagaaattaggattgctagacttaccaaataaacatatagagttccaagttaattttaaatatcaagtaaatagcaaatactttatacaatatatcgcatgaaatatttgggatatatttatactaaaagtttattgttactgaaattcaggttcaactgggtgccctttatttgacaacactaactgtaaactatcaaaataaataaaatttttgaaccttaaaatataacaaatacaattaaagactcaagaggttcaaagcacaacagactagatatgactagatataattgacaagaggatgagtaaagtgctaagtaggtcagagacaacatatactgaaaaacagagagaaaaaaatggaagattcagaaaagcataagaaacacatacgacatagtgaataaatgtcaaaaatatttattgtggttcagaacagaaaaagaatggagaaaaagtattatttaaagaaataatggctagggatattctaaaactgacaatagaaaacaagtaatagattcatgcaacactgcatttattaagaaggataaattcaaataagccatacctaccacatcatggaaaatagtaaaatgaaaaaaaaaatcctaaataagctagataagaaagtgtcatactacctttaaagttgcaacaatattataacacgtttaattgatttactataagaaacattggaaactagaagtcaaaaactgtgatccttgaatttttcttagggggcaggtaccatattgccaaactagaattttattcctggcaaaaacattctttaaaatgaaaagacaaataatggagaatgaacttgaaattgaacggtttagaattacaaagattttttcccctatttccaggtgagctcaacagccaattaagttttattataaaaaataaagcagcttatatctacttgaaaaagtgaaggcaaaattaaaatgttttcatttaaactaaaagtcataggatttatcactagcagaactacactaaagagctcttcagccatcatgagaatgttttgaaatataagcagaaaggaatgaaaaccagtgaaaaggatattatgtgggaacatctaaaagaatacttcccatacaaagcaacattattaattacatagtttcatgcacgtccgtgtgaagagaccaccaagcaggctttgtgtgagcaataaagctgtttatttcacctgggtgcaggtgggctgagtccgaaaagagagtcagcgaagagagataggggtggggccattttataagatttgggtaggcaaaggaaaattacagtcaaagaggggttgttctctggcaggcaggagtgggggtcataaggtgctcagtaggggagcttttgagccaggatgagccaggagaaggagtttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacattcctgtcttcttatattagtaagaaaaataaaatgaaatagtggtaaagtgttgggacagcgaaaattttgggggatggtatggagagataatgggcgatgcttctcagggccgcttccagcgggattggggctggcgtgggaacctagagtgggagacattaagctgaaggaagattttgtggtaaggggtgatattgtggggttgttagaagaaacatttgtcatttagaattattggtgttggcctggatacagttttgtatgaattgaaaaactaaatggaataagagaaggagaaaaacaggtataaaaggtctaagaattgggacgactcaggacatctgattagagagtccctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgactagttttttggggcacagtctaagttggtctggtgtctggaatgagactggggcctaataaaaaggagcgtctatacaggagctcaaatgggctgtactttgtagcattctgaggacaggtctgacttctgagaagggaaagtggtaaaagtattgtccagtcctttttaagttggtggctgagcttggtgaggtgtgttttaaaaagatctttagtctgttttacttttcctgaagactgaggactgtaagggatataaaggtttcactgaatactaagagcctgaaaaacttcttggctgatttgactaataaaggctggtctgttatcagactgtatagaggtgggaaggctaaactgaagaattatgtctgacagaagggaagaaatgactgcggtggccttctcagaccctgtaggaaaggcctttacctatccagcgaaagtgtctacctagaataagaggtattttagttatctgactcggggcatgttgagtaaagctaatttgccagtcctgggtgggggcaaatccttgagcttgatgtgtagggaatggagggggcctgaataatccctgaggagtagtagaatagcagatggaacactgagaagttatttctttgaggatagatttccacgatggaaaggaaatgagaggttctaagaggcgggctagtggcttgcactatagcatagcctgcctttgctgatgtgtggcgattaggcctggtggaactgccatcaataaatcaagcatgatcagggtgaggaacaggaaagaagaaaatatggggaaatgggataaatgtcaggtggatcagagagatacagtcatgggggtcaggtgtggtatcaggaataatgtgggaggccggactgaagtccgtgccgggaacaatggtaattgtgggacttaacaaagagtgagtacagctgaaggagccgggggagcagaaagtacatgcatcaggtatgaggaaggaaatagattttggaagttatgagaaatgtagagagtaagttgagcatagtttgtgattttgagggcctctaaaagtattagggcagcaggagccgctgcacggagacatgaggcctaggctaaaacagtaaggtcaagttgtttggacagaaaggctacagggtgaggtcctggctcttgtgtaagaattctgaccgcactaaccatgcctaggaaggaaaggagttgttgttttgtaagggattgaggtttgggagattaatcggacatgatcagcagggagagcacgtgtgtttttatgagaattatgctgagataggtaacagataaggaagaaatttgggcttgactgaagtaatgggggctgtctgtgaagctttgcggcagtacagcccaggtaatttgctgagcctgatgcgtgtcagggtcagtccaagtgaaagtgaagagaggctgggatgacgggtgcataggaatagtaaagaaagcacgtttgagatccagaacggaataatggattgtggagggaagtattgaggataggagagtatatgggtttggcaccacggggtggataggcaacacaatttggttgataaggcataaatcctgaactaacttgtaaggcttgtctggtttcaggacaggtaaaatgggggaattgtaaggagagtttataggctttaaaaggccatgctgtagcaggtgagtgatagcaggctttaatcctttcaaagcatgctgtgggatgggatattggcgttgagtggggtaagggtgattaggttttaatgagatggtaaggggtgcatgatccgtcgccaaggagggagtagaggtatcttatacttgtgggttaaggtggggggatacaagaggaggacgcaaaggaggctttgggttggggagaagggcggcaatgagatacagatgtagtccaggaacagtcatggaagcagataatttagttaaagtgtctcggcctaataagggaactgggcaggtggggataactaaaaaggagtgcttaaaagagtattgtctaagttgccactagagttggggagttttaagaggtttagaagcctggccgtcaatacccacaacagttatggaggcaagggaaacaggcccttgaaaagaaggtaatgtggagtgggcagcctccgtattgactaagaaggggacggacttatcctccactgtgagagttacccgaagctcggcgtccgtgatggtctatggggcttccgaggtgatcaggcagcatcagtcttcagccgctaagccgagaagatctgggaaggagtcagagagccttgggccagagttccaggggctctgggagtggctgccaggtgagttggacagtctgatttccagtgggttcctgcacagatgggacgcggcttatgaggaatcctgggctgcaggcattccttggcctggtggccagatttccggcacttgtagcaagctcctgtgggaggaggttctgggggaacgcctggctgctgtgattcaggcgtttggaagttcttgtgtgctggagatgtggctggggtttgtctcacagtggaggcaaggaattgcaacttttttctattattgtacaccttgaaggcgaggttaattaaatcccgttgtggggtttgggggccggaatttaatttttggagttttatttaatgtcgggagcagattgggtaataaaatgtactttgagaataagatggccttttgaccttttagggtctagggctgtaaagtgtctcagggttgctgccgaacgagccatgaactgggctgggtttttcatatttgatgaaagagactaaacgctcactgatttgggaaaggtctgataaagaaaaaggagcattaaccttgactatgcctttagcttcaccacctttttaagagtaaattgctgggcaggtgcgggagggctagacgtgcaatgaaactgtaagcaggacccggtgtgaggaggggaggtgataaaaggattatagggtggaggagccgaggctgaggaagaattgggacctagctcagcctggtgaggagcagcctggggaggaggggagaggtcagatgggtctgtagaaaaggaagattagaaagactcagtgacacttggggttgggactgaggggacaggcgggagggaaagaaggaagattgggggcgagttgcactgggtacagagactagggagggactgatgtgtaaaagaatgcctggacatcaggcacctcagaccgtttgcccattttacaacaagaattatttagatcttgcgggatggaaaaattgaaagtgccgttttctggctatttggaactactgtcaagtttgtattggggtcaactggcattgcagaggaaaataagatgcttagattttaggtcaggtgagagttgaagaggttttaagttcatgagaacacaggctaagggagaagaaggaggaatggaaggtggaagcttgcccatagtgaaagaggcaagcccagagaaaagagtagagacacggagaaggggtcgggggttcttgccctccagaaaagcagagaaggggttggggcacagagatattaggtcagggtgcagaaataagggatcagggtgcagagatataagaggtcggggtgcagaaataagggatcagggtgcagagatataagaggttggggtgtggaaataagggattggggcacagagatataagaggttggggttcctgcccctcctctagaaaagcgggacttgccgctaagagtgaaggagaaggggttggaggtttcttgccccccagaaaggcggtgaaggggtagagacatggagagaaggggttgaggtacttgcccctcccctagaaaagcgggacttgccgctaagggtgaaggaccaaggcaggtgtccctgtgtggtctgacacctctgaaatgtgggtgaataatcaggcatccctgcaatgattaaacaccaagggaaggctgccttcccagtctgtgacaggcaccggagttttgggtccatggataaaacgtgtctcctttgtctctaccagaaaatgaaaggaattgaaattaagagaagggagagattgaagtgtggcgccaagattgaaaggagaaagaggctgagggatagtgagggagattggagaagagagtaaaaagaggctgcttactagatttgaaattggtgagatgtttcttgggctgattggtctgaggacctgaggtcgtaggtggatctttctcacagagcaaagaacaggaggacaggggattgatctcccaagggaggtctcctgatctgagtcatggcaccaaatttcatgtgcatccatgtgaaaagaccaccaagcaggctttgtgtgagcaataaagctgtttatttcacctgggtgcaggtgggctgagtccaaaaagagagtcagtgaagagagataggggtggggccattttataagatttgggtaggtaaaggaaaattacagtcaaagaggggttgttctctggcagacaggagtgggggtcacaaggtgctcagtagggaaacttttgagccaggatgagccaggagaaggaatttcacaagacaatgtcatcagttaaggtaggaacaggccattttcacttcttttgtggtggaatgtcatcagttaaggcaggatctggccatctggatgtgtacatgcaggtcacaggggatatgatggcttagcttgggctcagaggcctgacacataggatttaaaatatggagagaataagaatacatggcaacaatagcataatagatggagtgaaattgagttaacatctaaatgccttgcatttttgcggaagctttaaactactatcttatattagaaatgaataaggatatatatcgtatgtttaaggaaattcaccatagaaaacaaaaaggatgtactatataatagtaaactaatgaagaatgtaataatgaactactctcaatataaaagaaataagtaggacaatataaaacagataggacaatttattttattttattttactctaagttctgggatatatgtgcagaatgtgcaggtttgttacataggtatacatgtgccatggtggtttgctgcacctataaacgtgtcatctacgttttaagccctgcatgcattaggtgtttgtcctaatgctctccctccaattgccccccaccccctaaaaggccctggtgtgtgatgttcccctccctgtgtccatgtgttctaattgttcaactcccacttatgagtgagaacatgcagtgttttgttttctgtgcctgtgttagtttgctgagaatgacggcatccagcttcatccatgtcctggcaaaggacatgaactcattcttttttatggctacatagtattccatggtgtatatgtgccacattgttctttattcagtctatcattgatgggcatttgggttggttcaagtgtttgctattgtaaatagtgttgcaataaacatacatgtgcatatgtctttatagtagaatgatttataatcctttggctatatacccagtaatgggattgctgggtcaaatggtatttctggttctggatccttgaggaatcaccacactgtcttccacaatggttgaactaatttacactcccaccaacagtgaaaaaacattcctatttctccacatcctctccagcatctgttgtttcctgactttttaatcaccatttaaactggtgtgagatggtatcccattgaggttttgatttgcatttctctaatgaccagtgatgatgagcttttattcatatgtttgttggctgcataaatgtcttcttttgagaaatgtctgttcatatccttggcccacttttggatgaggttgcttgatttttcttgtaaacttgtttaagttccttgtagattctggatattagacttttgtcagattggtggcttgcagaaattttctcccattctgttagttgcctgttcactctgatgatagtttcttttgctgtgcagaagctctttagtttgattagatcccatttgtcaattttggcttttgttgcaattgcttttggtgttttagtcatgaagtctttgctcatgcctatgcagataggacaaatttttaaaaaattcatagaatagtccatttaaactcaaatagttcagctattacattaagttaatatggacaaaatcctgcaattcgtaggcaaacaatttaaaattgaatactgaaacaaaatgtaactgtgttctgctgataagagatgtgtctttaatacaaaaataagaaagactgaaagtagaattacggaacatgataaacctaatcaaaacaaagcttgtaattctaaagaaactatactgaaaagcaagaaatatttatacataaagtttgaaattttataatgataaaaagataaaacaacagaaaaagatgacaaaaataactttgtaagcatttaataacctaatctcaaaatgaataaaacaaaaaagtacaaaataaataaacaatagaagaaaaataatgaatagctacatttacagtcatagttgaataatgcagtttttctcagtaactaaagaataagcaaaagatgattggataaattaaatatgttatatacatataatgaaatataattttgcaataaaaataaatgaagtattgatacatattacattaaacataaattcaacttgaaaactaagtgaaaatccagtcacaccctagacaaaaacttacaaaaagatattgtaaaattccatttttatataatgtatgtaataagtaagttcatggagttagaaagtattttggtgcttgcctgggactgatagatgaaggtgggggaataatgagaatgactgctgatgaggacaagtgtttccttttaaagtgatacaaatgttccagagtttgatgatggttgcacaaatgtgtgaatgcaataaaaaccactgaattatacactttatttgataaattataaattatttatccataaaactgcaaaaatgattttttaactaaaacttgcattcaatctcatccacctgtaaatggcattaaaattattttcagttcagtatattctagaccagtggttttcaaccaagcctaactttgtctcacaaggaacattcgtaatgtccgaagacatatttgattgtaacagtagaggtggagtgggtatttgcattaactaggtagaagccagaaatactagtaaaaatcttacagtaggtaagacagctttcaaccaaaacaatacaaaacaaaacatgtaactgccccaaaatatcaatagtgcaaaggttaacaagccctcttttagagacattgatctctattcctatataatttttaagcctcatggtaatagagtctatcttggaatgtgaatgaagcataatgtaaacattacaagcaacaacatgtcacatttttagaatttacatcattcagaataccccttagtatcacctgaccccaaagcttagaatgattttgccaattttgcaaatatgaaaacttagattatgttattctttttctaatgggccaagaaaggtataacactacactgtcactttttttttacttctatactaattactttctgaatatatatagatatctaatctatctatctatctattcttttaccacttaaaaatattattttaatctgtttaaaactaaggcctagcattaagagatatacctaatgctaaatgacaagttaatgggtgcagcacaccaacatggcacatgtatacatatgtaacaaacctgcacgttgtgcacatgtaccctaaaacttaaagtatcataataataaaattaaaaaaaaaactaaggcctaaaaataagaagtgctattttgtctgacagcaaaataaataagtagtttttaaaatagtaagctgaagtttaataattatgttaaaattatagtaacttttttctgcagtaattatttttgataaaaattaatgcaattacatgacataaaattaagatatagtttagtaagaaaaacacaaaacaataaccattgtagaatgaaaataagttttaatatatgaaagacttaagaatcctttaatacattaaactgactgatactagtgttctttgctgaatcataggtaacatatttattgatttttaaaatagggttagcgtagaataaatgaaatttataatttaatagtcatcaacttcacattcattttgcataccacaggagaaaaaaagaggctcagaaagattaagttctaaggataattgattttaaaattggggccagaattaggactcaaacgcatattttctgaggtctagccctttgtatattacacccttgctgaagactaaattcgagtgtgtgtcttattggcagtgagaaggcagatttgccaatatgtagtttctaaatcttgcatttatttctatacattttaaatttaatttagaaatagaacagggagagtaatgttagcaagatggtcaatcagagttgtttggcactcatccccacaaaaagggttgtggggttcccctccaacataacaaatgaacaactatatttcagtggaagttactgaggaagtatgctggggaacataaggggagtgaaaaaatccctgtgaagcacagaaactcaggatagaaccataaaagaagagggagacacacaaactctaccaaattgttccctcactgggattggctcatagccaggaggggctactgcttatcgagaaaaggtaagctggagacaccagttgtccccattactactgcagatgcctgcaggctgctacgggagggtcctgcaagcctcacagtcaacaaattctatctggggagctttctggagttcacatagctgtgttgccctatactaggagcccatttcgtatacccaccaactcccgtgacctaagttggaactgcatagtaccatcctgaaaccagactgactgctagagtatgtcctactctgggggccagtagccactgtgtctctccatccctgaggccccagcatcattccaccatgctcacaaggaaggccacagaactacaaccccagctactttaagcttaggcccagtggaatggcccaaatccatgcaacatcccctcctccctgggaaacaggcatatctgcacagcaagaaagccaacaagcagctgattggcctgtggtgcctgtgtgcctgacccaacaggaaggatggcagcagccccacccattgaagaacccacctcagagttggccagcccactatacctatgtaagccatgcctgacagccagactaggggtggccctgcagccctggaaagtccactacatagccagctggcccaccatgcaagtctgtctaaacagtgaggctggtagcgttgcccctaacaaaactgagccattacaatcacaaactcctgtagcctaggccactgatgaaattgcagacatcattgatgagaattatagctaatgaaactgcagagaaccacacagaaccaaagataatggatcatactcaactgacatcctagacacacctataggaaaaagtctctccttacaaaagttagcccgtaaagttggaaaagataactgttccaccagatatgcagatatcaatgcagagatataagaaacatgaaaaagtaaggaaacatgacatttccaaaggaaaataataattctacattaacagccccccataaaaaaatttatgcaattcctggaatttaaaataatgattctttttaaactatgagatataagagaatatggacaaacaattcaatgaaataagaaaaataatttattatctgaatgagaaattcaacagagggacagatataaaaaaagaacaaaacagatatcttggagctgaagaattcaatgaataaaagaagtacaactgagaggtttaacaacatactagccattttggcagcatatgtatttatgatttgtatagaagaaacagtttctaaatttgaagacagttcttttaaagtaacctaattagaggggagaaaaagtaaacaaaaataaaaagcaataaagaaagtctacttatgggacaccattaagtgaatgaatatttgcattataagaatgccagagggagaagatataaagaaaggcagaaatattgaaatagtatgtggaaacttcccagtcttagcaaacatatgaacaaccagatttagaaactctaagactcccaattagattacaacaaaaatgatctactccaaggtacattataatccatctatcaaaagtcaaagacaaggcaagaattctgaaaactgaaatggaatagtgtcaagtcacatataagagaattctattatactgtcagcagatcaatcattagaaaccttgcagcccagtagagaatggtatgacatattcaaagtgctgaaagaaaaaaaaaatactggcaaccaagaatactatatcagcgaagctgtccttcagcaatgaaggagaaataaaaaccttcccaaataagcaaaatctgagggaattcatcaccactacactagtctttacagaaatgcttaagatgatagtgctacaactgaaagtgaagataattactattatggaaacacatgaaaatataaaactcaccagtagagggcagctcataaccaaaatcagaatatcccagtgctataatagtgctatgtcaatcttttaatcttctgatataaagtttaaaaaccaaaggggtcaaaaaacaacttctacaattagtcattaagaaaaacaatagataaagacacacattaaggcaacaaatatataaattacagggaggggtcaggaaaaaatgtctagagtatttttatgtgaccaaaattaagttgctctcatcttagaatagtcgattataactacaagaacctttatgttagcttcatggtatccacaaagaaagaaattacaacaggtacacaaatgagaaagggaaaggaagcaaagcttagcacagcagaaaaccacccagccatagtagtaaataataaaagagaaaaaaagaacaaagagtctatacaacaatcagaaaacaattaacaaaatgtcaagggcaattcattgcctctcaataataaccttaaatgtaaatggattaaattcttcaatttaaagattgcattgttgaaaggattttgaaaaactaagaaccaactgtatattgcgtacaagacactcactattaaagataaacccagactgaaaatgagaggataaacaaagatactccatggaaaagaaaaccaaaagcaaaaggagtggccatatttatgttagataaagtacactttaagtcaaaaactgtaaaaagagacaaagaaggtcattatatttaataaagggagaaattcaacaaaaggatataccaatgataaatatatatgcacacaacaccagagtgtctaaatacataaagcaaatatcagatctaaagggagagatagactacaatgcaataatcacaggaaatttcaacttcccacttttaacaatagataggttgtctagatataaaatcagcaaagaaacatcaaacttaagctccaccatagtcaaaatgaatctaacatatacttacagaacattccctccaataattgcagaatataccttcttctcagttgcacatgaaacattctcaaggacacaaaacatgtttcaacatatttaaggtagagagtatatcaagtatcttttttgaacacaatggtataaagctagaaatgaacaacaagaaaattttagaaactttacaaatatgtggaaattaaacaaattgcttttatatcaccaatggatcaaggaataaattaaaaagaaatttaacaaattccttgagacaaatgagaatgaaagcacgtcgtttcaaatcctatgatatacaatgaaagcagttcaaacaaggtaagcttatagtaataaacacctatcacataaaaagaaaaagctttcaaataaacaacctaacgatgaacctcaaagaaataggaaagcaagaaaaaaatatataaattggtagaagggaaaaattaataaagcctaaaacataaataaatggacacaagaaaaacagttcaaaagatcattgaagagaattgttgattattttggaaaaaataaacaaaatttacaaaccttcagccagactaagaaaaaagagaaaactcaaattagtaaaatcagagataaaaaaagagacaatacaactgatactacagacatacaagagatcataaaagactattgtgaagaattttacaccaacaaatttggtaacctaaaaaagaaaagataaattactggacacatacaacctaccaaaattaagttgaaaatcataacagaccaataatgagcaagaaaattgaattagtaaaaagtcttccatcaaagaaaagcccaggatctggtggcttcactgatgaattctaccaaacattttaagaagactaataacaggtttttttgaactattttagaaaattaaagaggggagaatattttcaaattcattttacaaagccagcattacattgatgtaaaaacaagacaaagacacaagaaaaaaaataaataaactgcaggtcaatacacctaacaaacatagatgcaaaaattcttaacaaaatgatagcaaactaaattcaacagcacatcaaaaagatcattcactatgatcaagcgggattcatcctagggatggaaggatgttttaacataacatacacaaatcaataaatgtggcacaacacattaacagaaagaaagacaaaaacaatgtgatcatttcaatagacacagaaaatggatttgacaaaatttaacatccttttataataaaactctcaacaaattaggttcagaagcagtgtacctcgacccaataaaggccatacaaatgacagactcacagctaagatcacatttaatggggaaaacccaaaagattttcccttaagattagaaataagacaaggatgttcattttcactacttctattcaatatagtactggaagttctaactagagcaattagacaacagaaataaaataaataaataaataaatatagattagaaaggagaaaggcaaaatatctctctttttacaagtgacatgatgttacagaaggaaaacactaaagattataccagaaaactgttagaactaataaacaaatttagtaatattgcaggacagaaaatcaacatacaaaaattagttgtgattttatagacaaaggttaactatttgaaaaagaaatcaagaaaataatttcatttacaatagcaacagaacagaaagataccttggaataaaccagaggcttgataggtatttacactaaaaactatgaaacatcaatgaaagaaattgaagaggacataaagaaatgaaaagataaactctgtgttcatgggttgaaagaattaatattgtttaattggccatattacccaaaactgtctacagatttaatgcaatctatatcaaaataccaatgacatgcgtcacagaaataattttttaaaaatctctaaaacttatgtggaaccacaaaagacccaaaatgtccacagcaatcttaaacaaaaagaacaaagctagaggcatcacattacttgacttcaaaagacatcacctaactcccattacaatggctatgattaaaaagacaaaagaaaacaaggttggtgaggatgtggagaaaagagaactcttggtggtaatataaagtagtaaagcaattacaaaaaacaggatgcaggttcctaaaaaagttaaatgtgggaccatatgatccacaaattctactgaatatatacatacgaaggaaataaaatcaatatgtcagagacatctgcacttccatgtttattgcaacactatttataatagccaagacttggaatcaacctaaatgttcaacaaatagtaaatgtatacatatttacacaattgaatattattcagcaataaagaaatgaaactgtgtcatttcagaccaaatggttgaatacggaggactttaaatgtattcgtctgttcttaggctgttaataaagatatacccaagactgggtaatttataaaggaaaggggttttattgactcaccattcagcatggctggggaggcctcaagaaacttacaatcatggcagaaggggaagcaaacacgtccttcttcgcatggcaacagcaaggagaagaatgagtgcccagtgaagggagaagcccttcacaaaactatcagatcttgtaagaactaactcactatcaccagaaaggatgggggaaaccgcctcccatgattcagttatctccattggttcctcttacaacacagggtattatgggaactacaattcaagaagagatttgggtgaggacacagcctaaccatatgatatcatgttaagtgaaataaataagacacagaacgacaaacaccaaatgatctcattcagatgtagaatctaaataaatacgttgctcttacggaagtagatagtagaacactgttttaccagagatgatttggaaggggaaaatggagagaggtttgtcaatgggcacagagttacaattaaatagaagaaataagttctgttgttcgattgcatggtagggttactaaggttaacagtaagttgttgttaaatgaatttttgttgttgttttttttttttttttgagatggagctttactctgtcacccaggctgaagtgcagaggtgcaatctcagctcactgcaacctccgcctccccagtgcaagggattctcctgcctcagcctcctgagtagctgggactacaggtgcatgccacgacacccagctaatttttcatatatttagtagagatgggtttcaccatgttggccaggctggtttcgaactcctgacctcaggttgatccacccacctaggcctcccaaagtgctgggattacaggcgtaagccaccatgcctggacattaaatgaaatttaacctaaagctgcattcttacatattttaagttgagcctaagagtctcttcctacatagtgaactgtaacctaagtggatgtgtaaccagattataatttaaccttgtgccaatcactgggtttcagctaatcaaagcagccagttatccaaatcgtgttcaaataaggcaaacaccaagctgtaaccaatctcgctgtttctgtgtctcacttctgttttcagtacttcatttttctttttctgtccataaatcttctacgtggctgcactggagtcccctgagcctactctggctcagaaggctccctgctttgcaaatggttctttgctcaattaaactttattaaattgaatttgtctaagatttttcttttaacattacaaaacagctaggactgatgtctttgaacattctcatcacaaagaaatgataaatgcatgaggtaatgaatatgctaactaccctgatttgatatttatgcaatgtatacatgtattgaaaatcaaatggtaccccataaatatgtacaaatataatgtgtcaatttagaaaaaggaaaaaatagaacttgggaagaaatatatcttctaagaagatggcattttaggaaaacaatctctactaaacttattttcaaatgtttataaattgcataatttactttgaaagaggtatgaatgacttaaaattcagagtatcaagacttctaagttattaattgatatgtaaatacatatgctacattatgaaatataacatgttaataaatatatacctattgaaaaagtgtatacgtttatttctaagaaatataaactctagtacaattctattcctatttgaccagatgtctcctcacaacctaggtgtttgttttaatcatctctcttcctgctagactaacttgacatgtataaattctctactaatgcaattaaactgacctgcgtaagagacaaaatagccaatgacaaatctattactaagatcttgcattagtgtggtacatttgttacaattaaagaaccaatagtcacatattattttaactatagtccatggcttacattaattttcattccttttatcatacagttctatgggtgttgatatacaaactgcatatacctacagtttcatgaaaaatagcttcacctgtgattcacctatttatcctttctcttcctcctcacaagcctctggcaatgactgattttcttttttttttttttttacagtctctatagtttttctctttctaaaatcccatatggttaaactcatacagtatatagacttttcagatgggcttctttcacttagcaaaatgcatttgatgtttccctgtgtcttttcatggcttgatagttcattttgtcttcttgatatgccattacactaatatatcatagtttgtttatccatttgcttactgaagggcatcttggttgtttctaggttttggtgattataaacaaagccactgtaaacaggtttttgtgtggatgttagattttcacctcactcaagtaaatacctaaaagcataattgctaggtcatatggtaagaatacgttatgatttataaaaacctgccaaaccattttccacaatggttgtatcattttgtaatcttgtcagaagaaataagtgttcctgttgctgtgcctccttgtcgatatttggtgttggcaatgtgttgggatgtgatacatccattctaacaggtgcatatttcattgttgttttaatgggcagttcacatgtgtattttttttccttttctacagccgtattattccaacacttccacttgttgaatcgatggcctatgttgcttcattgggacggcagaaccaggtcttgaccataaagtaagtctttaattccaggcttttatatatgggagaagagtaattttttaaatccacaagaaatccttcacatattatgaatatatatggggcattatgtcaaaccacagtgtgaagggagaacatgccatctggagtgggggtttggaggcaccgggaaatgcctctgctttgaggagtcgtcgtccaggatttgagagagatttaaagtttattgttctagagaaggctttcattacccaagatttccccttccccaggctcttagccacagaagaaggggcgaggaggcagcaaggtgagtgagttgataggaaagggctgaaggaaaatgcttgaaaatactgtcagggctctggttgcttgagccttgcctcccactactccaccagcagagagcagcagaagagaagcaatggaatgggaagagctcctctataacttgtggaggggttcatttctcataggtgccatgggttctgcaaccagcaacacctgggaaagcagcatcttattctaagtcagagagaggctgagtccacttgccatgtccaagtggggcacctttgttctcactcgcagaaatatatagtatgagcctgtagtgccatagatggtagatgaagatggtctctacagacattggtcagtgttagctctcctcagcaggtatatggcagaaacagtcagcagacgtatggtggaaactcagaaaggacaggatcaatacacagaaggtagtggggaatgaagaatagggctgactggggacagtggttcatgcctgtaatcccagcactttgggacgccaaggcgggaggaatgcttgagcccaaaagtttgagaccaacttgggcgacatagtgagaccccttctctataaaaaacaaaaacaaacaaacaaaatagctgagggtggtggtgtgtgactgtggttccagctactcagtaggctgaggtgggagtatcacttaagcccaggaggccgaggctgcagtgagccgtgatcatgcctctatactccaaactggatggcagaattagtaagaccatgtctcagtaaaaaaaaaaaaaaagtaagaaaagaataaggctcagggcaaaagtaccatggcagaggctggtggtggacattaccaatgtgggagattaaagagtcccagaaagccagcagagtcagcaagattcaagatggaggcctagtcattgggccatctggctaagctccatgaacactattattgtctatccacacccttgcggatctcaggaacaatcaacacacgacagtagctacagacacatcagtccagacccagagagaacagaacttatgtccataactcaagtgacatatggtgttctccaatcagaggtcacagaagcaagccaaaatgaacatggaggttgatagagtttggatatttgtccccatccaaatctcatattgaaatatcatcttcaatattggagataaggcctggtggtaggtatttgagttatggaggtgaatccctcgtggcttggtgctgtcctcttaataatgagttcttgagagctctaggtgttgtaaagtgtggcacctcccctccgatctcactctgttcttactctcaccatgtgagaggcctgtccccccgaccttctgccatgattggaagcttcctgaggcctctgcagaagctgagtagatgccagtgccatgcttcctgtacagcatacagaactgtgaaccaattaaacgtcttttctttataaattaccccgtctcaggtatgttttatagcaatgcaagagcagcctaacacagagatccttgcttcttctatgagaatgagtaaacttaccttgaatacggtaacacccaggaaaagggcaaagaggaggtagaagggggagaaacctgaaataccaagcagttatccaaatgatgctgaggttacctgaaataaactgttttatactggaagcaacagaaatatcttgaagagatccattcaggatttttgtctttctccccaatactgagcaagaaaaaataatagcaaatacttaggcaacatttactatctaataggaactattctgcgtgtttcaaatatattaacctatttaatccttacaagaaccctgtgaaattattatacccatttcacaaatgagacccacagagattgagcaaattacacaaagttatccagctagtaagtttcagagccagaatttaattcaggctcttagccacaatgctatttttaagctttgtttctttttattttatttagaaacatggtctcactctgttgcccaggctgaagtgcattggtataatcatggctcactgcagcctcaaactcctgggctcaaacaatcctcctgcctcagtctcctgagtggctgaaactagaggtgtgagccactgagcccggccagccactatgctatgttgcctacctaaggcataataaacccagtgacggaaaataaagtttttgtggtcattgttttgttgttacacatatgaattgtagcaaatgcaccatgatccctactatagaaatgcaagagaataatttcaataacaacgataaagattggtgcgtagatgtactcaggttaatgggggcacaagaaagagggaaatggatttgtaaatacattcctgcagagggtaacacatgagctgggtctcagaaaaagagatctgtggttctgaaagttgactgtgtgctagaattaacaggaaggctttgctaaaacatgaaatactggggaccatccagagtttctgattctgagatctaagctagagccatatcacttgcatctctaacaggttcctaggtgctggtgacacagagggatcactcttcgaaccagagttagatggaaaagaacattgggaaagaaacactgggaaagaaagcaggttgagtggaggattaaatatgattagtttcatgcgcgtccgtgtgaagagaccaccaaacaggctttgtgtgagcaacatggctgtttatttcacctgggtgcaggtgggctgagtcggaaaagagagtcagcgaagggagataggggtggggcctttaataggatttgggaaggtaaaggaaaattacagtcaaaggggggttgttctctggcgggcaggtgtgggggtcacaaggtgttcagtaggggagcttttgagccaggatgagccaggagaaggaatttcacaagacaatgtcatcggttaaggcagggacaggccattttcacttcttttgtggtggaatgtcatcagttaaggcaggaactggccatctggatgtgtatgtgcaggtcacaggggatatgatggcttagcttgggctcagaggcctgacagtatgaagcaaggcaaaggagagagaaagcagaagttgggtaatgcttagtggtgtgaatttggagcagaaaaataacatgagccaatgtgtaacagaattccttggaaacctcaaaaattctgtttaaatgtgataattttaaagctaataaggcttaatgagaagaaaatagttctttgtgtataaacattttgagaaagagaatcaaaagacgctgaaatgcttcagtctgtgcacaaatatctgtgaatatctgtacctaacagaagttttatcttttgcctcttccctctctgctccatgcacaaacttactcatggtgacactccatccactgatgatgtctttttttgtcaaataaaatgttgaacattcttgaaaaaagcttgaagggactatcactgcccttctatatctagtgacgtctttttgttcaagaaggtaggttcactctgtgtaaagttttacctggacttgaatgtgagattgtaacactgccaacaaaagcaacattccatgtctcgaattgaaatgtaatctgtcaacccatttaaaacaaaaaaacaaaattacaacaaatttaggttagatatttaattggcttttatttacaattcatgaatgtgggcagcatctcattttataaaatagaataagaactccgatgagcttgttggatacagtgagttctaaacttctcttcaaagaatcagtatgtcagtatgttcagttctttgtcctccattttaaagtttaacttcctcgtagtttcagtaagcaacctttcccaccagttttaatcagtagttcacatctgttcccctggtcacctgctctgacctgagtcatcccagtcacctgctctgacctgagtcatcccagtcacctgctctgacctgagtcatcccagtcacctgctctgacctgagtcatcccagtcacctgctctgacctgagtcagttttagtcaccggttctgtcccaccaaactgctcaccccgccactctggctcatacccctgctctctttaaaatacccaatcagaattagcttagactgtgcagtccaaccctagccaacaggggaacgacacagcagtaggggcaataagaaccccttcccctccctcgttcaggtgtgctctcgccattgctccaaccatgagtcgcaccctactacagaagtaaaattaccctgctgagagaaaattatttgtttgagcactagttcgtcttttcggcatcgaagaacaagcatttgtttctaacaagctgagcagaggaggttggctttgtaggcagaaaagagttgaagaaaacagaacaaaaagcagattagtcatttcaaagttactatcgatatagagttaaaacagggaattccttattacactggttcagataaactgggctgcccctgattgtttcctgtgaataatgtgggttttttggtttgtttgtttttgtttttttaatactggcttgtttcaaagttcagtttgattatgtagcacctagcatgagtgaatccgttctggtttgttatagtctgttggggctgtgaaaggaaactgaatcttagggtccccaaatcactaagcaaaagggaaaagtcaagctgggaactgcttagggcaaacctgcctcccattctattcaaagtcatccctctactcactgagataaaagcatatctgattgtctgctttggaaaggctcatcagaaactcaaaagaatgcaatcatttgtctcttacctacctatgacctggaagcccctccccactttgttttcccacctttgcttctagttgtcccacctttcaggaccgaaccgatgttcatcttacatacgttggttgaagtttcatgtctccctaacatgtataaaaccaactgtgccccgaccaccttgggcacatgttgtcaggatctgctgaggctgtgtcatgggggcacatcctccaccttggcaaaataagctttctaaattaactgagacctatctcagatactcggagttcacagggccaagtataggcacttactctaaaacaaggatttcataaatttatttcgtacagcagtcattgacatttgttcagtttctatgtatgttcaggtgcatgcacattcatgcacacaacaaactgaattttactttttccctctgactctactgattgtgtaaataattgaattggtagacataactgatgttttgggttttttcttattgttttttttgtttgtttgttttgttttgagacagactctcactctgccagccagggtggagtgcagtggtgcaatctcgactcattgcaacctccgcctcctgggttcaagcaattctcctgtctcagcctcccgagtagctgggattacaggcaggcaccaccacacctggctaatttttgtattttcagtagagatggggtttcatcatgttggccaggctggtctcgaacccttgacctcaggtgatctgcccacctcagcctcccaaagtggtgggattacaggtgtcagccacagtcctggctctgatggtttcttttcccttgagttgttagagattcttcattgagagaactttgagcagacatgtaaagaataaagttttcttttccatctgtctttttctctctgttcccactttaatgtttcaaaattgttttacattaagctactcattgcatacataaaatgatttggattaatgtttgtgtgtgtgtgtgtgtgtgtgtgtgtgtgtatttaattgtggaatgactcaattggttcagcaaaacaatttcatttaacaaagaactaattttttcttcaaatatattatattctttttttcaatttttgtttttaagttccaaggtacatgtgcaggatgtgaaggtttgttataaaggtaaacgtgtgccatagtggtttgctgcacctattaacccatcacctaggtatgaagcccagcataacatagagctaatcttaaaccaaactgccttctaacattctatcccctatatttgtatctgaaaaggttccattatattctttagactcttccaacatttgcctgctagaaatgagaaggtttttataacatctgatcctatgtatttatcactcataaatcagaaactcaatttgaaccctgtgaagtatggaggtttaaagcaaacctttatttaacattttgtatgtcaacatttttccaaacttgacctgccaagtggatttaatagcagatgactctggaacctgaacaagtgtttgctcttatatttcaactattagtattgaattaaagactacaaggtttggatcacatggcagacttctttgatgccttatgctgctgatgctggccaagaagaggaacatctgagtatttacatgtttatgcctggggaattctaagaaatctttggacatttgacaaatatgtgcctataccactaagcctaagattgcatccaaatcatgtgcaaataatttctcatagatgggaaaaatatactgatgctaaaaagatgtcatatgagctgtttaaaaataacagtccaggaaattcactttttgtgaatctgaaattatctctcaattatctcaataattgtccaaagtataagatcatctggggaatgatgaaaccaatgagagactccgtttaacatttcttgtgcatttccgatgagtgcaaattataccacctttttaacacattactatctccttttgttctcaaagcaatccactaaaatgacggccagtgctacttccatctctaattttctctcccatcagcctactcatatgtatgcatttggtggtttacattcatcaaggttatggggctgcttgcccgtagcttattctacctgcaaaataaagtattacatatatatatatatatatatatatatatatatatatagttttctatttccagcaacagtgatttattttaaagtagtttgtcatcagtcttacccttggctatcatgatatacatttgattgttctctctacttgcaaacttgccctcccccaacatatacgaatttaggtttgtattgataaacattcaatggtttttttaatcaagcatagaaatgtagaatacatctgaactctttagcatggtctacacgcaggttgccaaatcaagcaaaatatatacataataaatatgtatgcataagtgttataaaatgttacattttctacatttataaagtatacatataaatatatacatttaattatctatacacacacacagagttgattatcattatttgcagcactcatattctataaagttactgacagcactgaatgaaggaacacagaatcactgcccctagaggaaatagttgttactgagaacctctacttaaaacattttcataaatcaatcaatacacaaccttgtgttatgcatgtttctgtttgaatacactttattttatacatagtgtatttaacactattatagtattaattcattaatggttgaactcacagccaacagtatcataactcattcctgaatgaaggttttctagcacacattattttcttcataagacgtagcaccgtcttcttgcatttagaaagaactgcatttaaaaagcacaatgcaaaaagcaaacataacaacaaatagattgtgaaaaagacacgtgtagtatgcgagttataatttaagatcgtgttatttatatgtgtttttttattttaagctgtctccccaaggtccatgcttatatccatcttgtgctaagcctgatataatatctgatacatgaaaccttttaaaatatttgatgaagaatgaatggtttaaagaattaacagaagtggtgtgaggatatatgaaacaagagaatccttagttatgtatctaaacctagttactcattatttcatttattggctcattctccacatagttagggagtaccttgtgcctaggcactattcaaggctctaaaaatgaagcaagtataagaagaccaaggctcctgtcctcatggagcttacactctgctggggcagacagaaagtagacagaaaattcagttataacttacatcatcgccatgaagaaaacaaatcaatgtgtggaaagccagtgcaataaataggacactgacatcttgacactcctccccccaccactgtttcacaatgtgcagagtaaattaaacacacacaaacacttccatatatattcagttaattttcaccactctgtatgcagagaacagtgtaaatgacataaacagtgatagagaaaagcaattaaattcaaaataatcagtatgttaataatgtaactttttcaaagggtttttgcaaagattttaatttatttatgaaacacaagtttattgaatacattttatgtcaggcattcttataggcacagaggcagaaaacttaagattgtatttcagggaagggaaacattctaaacaaattccaatcttcaggcatctgatttagagcagcgagaacatgatatatgaatgtgttagcactctatatcctcagcatgttaatcctcatgaaactaagcctttagtaaagctcgtgtattaaacatgcctgttcttttaaaacaaatggcaatcctcataaacagtgtgtccattaacaaaaatccacctattttgatttttaaactccataaagctcagagtgcaacctgctgctgaaagttgactttttctctgttgcttgggacatatggattttgacagtagagttgtagaaactgtttagctatttttaaaccatgagttgctcattctcatgttaacgcttgagtatttcttacaggctaggtagggaaacttgggtgagatgtttgtgattaaacacataattttgacaagttacctaaagctctccttatgtgtttgtgctatagtccacaggtataatgcctctcctacttaaccatgtgtgtattacatgtggtatatttttacatgtggtattattatatatggtatacattatataggtattatatgtggtatatattatataggtataattatatatacatatatatcatataggtataattattattatgtgaatcagaggatcacataaaataatcatgtcatcctctgctggaaacaatgcattgacttcccactgaatctagaataaaatgtaacctccttaccatttcctgcaatacttaaccttctaatagccttgatcacctttccagcttctctcctttacattgtcccacttattctttcctttctggtctcacttgacaactttcagtctttcaaacagactgaactctttctttgccactagttctctctgcctggagtatttttacttccacttttcacatacttggctgttttcattttccagatttctgcttaattttcacatcatcagaaagaactgcacttattatttaccactgcaaaggggccctactccgattcattgtctcatagcaccctgctcatcttatataatgtttatctgaattgttttgctatgtttagacatttacttattggaggtttctctacagccaaataggctctaaatcccgatgaggaaaggagcatcggtgctttattcaccactgtatgtctactacaagtacagggtggacacatgaggggtcttaaccattacttcagtataaatgaattaatatataatgtaagggtttaggatctttcactactagcttacttcaaggaaagatcagggacactgtgttgagaagaccttacattgttcttggtttagccattgtgtctcttttactttagccaagttgttccgcatttttagattttgattcttatttgtaaattataaataacagatataattaatataaacacactatataatgtaaaaacataaggtgctattataataatcaataatgtattttaaaagcagataattccatggatcctcacatttccttatagacttctagtttttcatcaataaagcacaaaagatatagagtaaatgcaagaaaataaaatctctgtgaccctttttgatttcctatttccaatcctctttttacccctagtttagcaatgtctttattgccattctttatttctccaatggtttatgtaatataaaattataataataaacttgataaatttagttaatgaggaaatttatggaatgagtaaaaaatacaagtaaggaagacaattttttttaccacttctgaagactgttgttagttaatagaacaatatagttgaccctgggcagtgaaattatattcattgtccaatcacaacatctgatcaatggctcattaatatctaatagtaattacttatattgcttcacagttttttttaatctaaaatataaagttcttattgagaaaagaaaaacagataagacattggtcttcataatttccaatgttctctgttatccagttatttattcagggagaaatcttaggaaaatctatgaaaaattagaggaatgatactctttctggagaattaatttacctgctactgcttcttcccactatcctattagaggcataattgacttagacacacgggatatgccaacctcattaaacctgagagcccataatgtgcagaatcacagatctaaatagcttcttttaagtttccttatgccacatatttgtatgccatagaatactgcctatggtgggacgtgcttcttgcaggatacttggaggccatctgtttattctggcatgagatcctctatgacatttgaagacttggtagcacttagtttttagtttacttcccattaataaaaaaataaataaaaataagtttgctttctatttgtatcacatacataatcaacatttccatgtgtaaaacagaaggtatgagcaaatctgaacataattgtttagaacttctcctgcagctccctgggggaattgtgtctcaaacgccatcagtataggttatcaacaagatgagaattgaaaagcccaattagagattagaatagggatagctgataagaaacatgaccaagcaccccaaattcagcttgggaagtcaaattaaagtacagagggtgaagtggtctgcatcagctgccaatgaggaatggcaatatttaaacaatataagcaaggaactcagaattcattggccaattggaggtcaaaagcccaggtttggaattaggataagattttgctgtgaaagtgagtgtctgattcatcttcattctagacagacagttccaacactttttaagtctcaaagtccctttctattgatgcaccccaattaactatgaggaatcactgctctgagatctaattaattctaatgttggtttcagggttcccttctgtaccagcagtagtagcacatggaattttgtgggattttgacaaggaaattacattactaacatatcttgaagggattcctataacagtttcttgataccataacaggttcaggtcactaagagtcctgccaaagtccaggcatggtggttcactcctgtaatcccagtactttgaaaggccaaggcaggtggatcatgaggtcaggagttcaagaccagcctgtccaacatggtgaaaccccgtctctacaaaagatacaaaaaactagccgagtgtggtggtgcacacctgtaatcccagctattcaggaggctgaggcaggagaatcgcttgaaccttgaaggcggaggttgcagcgagcccagatggcaccattgcactccagcctggatgatggggcaagactccatctcaaaaaaaaaaaaaaaaaaaaaaaaaaaaaaaagagttctgcaaagacttcagtttcttaaagaaaaagaagatgtgttaatttgtatgatttgcctatttttttctgttgtaaatactcacagcatggtcagtttcaagttatcaaaaagttaaaattcctgaattcttcacattggtgttctctaactgattcaaacaggctctggcccatcactgctggttatacaaaccttctagaatgaggaaggaaattaacttttccaagatctccagattatgagataaggtcaatctccttcttttgtgtactgaatttgaacccggtctttcttagttgggaaattcactcttacatgtgttatctttttattctgctatattggatcttctctctcagctgacacattttcaatagctaataaacagtttctgccatcagacattcttaataaaaagccataccttgaccccacacgtaatggcaacctaaattttctactctgcttcccagcaaaactttgtaaaataatttttttattgttctcatcacttctacttacattccacagggacttgactcttagccaccaataatctctagattgccaaattaaatagtgtcatttttacttctatctcaatcttttattagctttagacagggatcgctacacccttcttctgggagcttttttatcctcggtttcattgacactaaacaatgttggtttttttctttctaacctctccttcttgatctcagaattccaactcttgaaatgtttcaagacgttatccttgggtctcctttcctttttttgtctacacactcaggactggtgatttcattcaatacaaggtgttaaaaagtcccaaatctcaatctcaagcctgatttctcctcagaattccagaattatatatccaaatgtctattggatatttccatttgaatgtctgataaacatttcaaatttaacatgtcctgaacaacatttttgttctattccaggtgctggcaaactatagctgtgagtcaaatctgggtcacataattttgttcaataaaattttattggaactcaaccacaccaattgtttgcatttgtctatagcttatttcacactgccacagagacctctttagtctgcaaatactaaaacatttattatctggctctttatagaaagttggccaacagctgacctatataccaaatttgctcttcttgaagtacgtatttatctgagttgataacactaccttaagtttatatctcaagtcaaaattctcataattgtctttaatgttcatccttttcttgcctactacccccaacacatcagcagttcatatgggctttaccttgaaaataaaccctaaatctagttttaaaatgtccactgaaaccaccaatgttgcttgaagcattgaaacaacttcctaatgatttccttgccaatttttttttacccttttacaactttatagtcttcttaagttatagaaaattcttcttaaatcacatatcagatcatcttttccttgcttaaaatcatccaatgggtatgtatttctcttagaattttctcaactccctaccttctcttacaaagttctgcataatctggattcttactcctccgcctaccagttctcttctcgctcttggcccactgaactgcagctgcactgagctttctcttactccaacatgctaatttttcagttctggccctttgagctagctgggttctctgcctggaattctctcatgaacgcctttcatgaatgtctccttctcatcaatcaggtttcagttcaaatgtcacttctttcaagaagcttcttcttaataattcattctaacagagtcgtacaagtatatatcatattatcacttacctagtttttaatgttcttcaaagcattttaactataagataggtcttctatttacttatttttgtatttatttgtttgctggtgatttttctgcctcttcaaaatagaatataaattctccaagaataggaatcatttctgtcttgttcattgaagcatccatagtatttaggacaatggtgaacaatattggttgaatggatgaatactcagctattatattccagagaggtttctcaaggtggtcttgaagaatgtgggccaggttaattttcttagactaattatgaaggcagaaggaagagcaatctattctattaatttaagtaatgtaagtatccctataaaagaattaatttatttttattgtatttttcttaaatataaataagtgtaacattagttataaactcttatatttgctacttttatgcactaaaaccaaaacaattaccataaattaatcaaattaagatgtttacttatgcaattattttattagttgccctgataaactctttgagggctggatccatgtacgaatgtgctcactaatgcgtcatctgtggttgaaaacattggctgggacatagagtttggcaaatacttgtggtaaattagtgctgaatagtaaataaatacatggcctctgcaatcaaggtatgtgtgtctagtaggataggcttaaagacacaaaccagttgaccatccatctgctagaaaattcctcagaacaactctgagcttcaatattaattgtgggcatttatcggcactaactatggtacactcttaaagaaataacaataactgaacccttataacaagctttgaaagcatttatactctgattatttccttattacaagatgaaggtgagaagaaactgggaggttgtctggccacagttaataagtagtagagccaggatttacagccagtgggtctgtatatagagcctgagttccattgattcccagctaatgagggagtaaatgattctttttcattggcaatgacccagatcccagaatcacaagttatatcccactagagcagactggattttactcattaaggttgcatttttaacaagataattcattcctactgctcgatacagtagctatagacagttacttttatctaaattactcaccaaaatttgaaggtagaaggaatttagaaatactcttgtcccacctcttcatttttcaactgaggaatccagagttctagggagattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacttttggaatcattgccagaatgtggtagtctgctcatcaactgttggaaatataatccttctgtatctttcagatgatcgggaatccttttcatttatgcatgcatacttacactcacctttccattcctttatttacttattcatcaagcatttcttgcatggcaattatgtgcagagctttgtacttggtaaaggggaaaataaagaatagttgaacatgattttattcaaattgattctatcctctattacattttattttttaatttgcctgaagtcccttcaaaggtagacaggttgtaatttctcaataaaatagatatgaaaaaccaacaaaatcttctagcatcaatgtggcaattagctgctgactgcaacatgtattttcttaaagttgctatgtttctgcttctatcaatattaatagctaatattattgagtgtttaatatgtgccaagcactctgttaaacactccatgtatgttaactcatttaatctcctcagcagttccacaaggacatatagttattatatgtatttatagcataaggttacactcctattaagtggtaggaaatccaaactttctttctccagggagtatatgcttaattgctttatcaaatttgtaaattgataaatttgtaaattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacaaacaattgtttgtaaattgttagcttctatagaaaatatccaagaatttcagtagaggagtgttcaggagcctgtgagttatcccacattgaaactaggagacacactgctcttcattttctccaacaaatacacctcactttctcttgtatgatttttcacagaattcctgccctattagtaacatagctgtgattttatttaatccaaatactgataagcaattgtgaaaaatgtgaatatctgagaacctgtactttgcaaaatacatttttacttaaatatgattctcttttagaaaatgctgttgcaaagtggtgcttatttgggctctgtatttttttggggggagcgtcccgatttataagggcaataacaactcaaaaaatggtatgagtaaaaatggctgttctcctgagcttggtagaagattggagaaagcataaatagcaatctactcccctgatttattctgagtactcacacaactgaggcccaaataaattataaagtgtttggctccagtggtgttattaaattccttgtaggctggaagcattgatcatttgatacccttaggtttgcgtttcattcaaatggtggaaagatatatactaatactatatatcatttcaacttcatgcatgagacttgaagcaagaaacttctgttatagctagcaggaatagtctgtgaggtgaattggatgtacactgcacatcaaagtattgataaattgacctacatttttaaagccgaaatgtaaacctcattgtgcatcaggaggtcgacactgtcagttacctagatatttctcagtgttaagtagttatattatgaaagatgaatgattctgtacaaccctgtataaatgtgactgcatttggactttctaaaagaatataagcatgtatgcttggaaatcctctacctatttggaaatagaacacactttgcagttgatggtagaaattatagatttcttctagagaaacatagaagttacagggatttggctgatgacaaagacatattcccacagcaccactaaatgctttctaaatacttgttatacttaaatacagtattccatataatatgggagaaacagtttgatgccattttagttacattgtgtatttagcatgaactccaaaaggaaactcagctaaactccataatctctccacttactggttcaagagtcagagttgaggagactcatgtggaattcttgacctcatttacattcttgtgtttcataacttctggccctcggtttcttatttgcatagacatttagtgtctagtaatcaacgtgttgtagattctataatgaccgtataattagcatcttctgtgcattatttctgatcccctacagagctcactttgaacatgagacataagactctgggagcactgtagggtaaattttgaaacagctattcattctggctcctatatttattgtttctgttttaaacttaatttcctattagttgttaaagtgttcacttatttttcaaagctctttgaaattacaaaaatgggtagctattctctaaatcttgcctgattttttttccctaaatggaaagtagtatagatttggaatccactaaataatacttaatttattcctttatctgggtggagaattaaatgtcacaattagtcattatttatatttattgtattctagagcaatgttttcttaaatacctcagttaccttcagataaagtcctttctaagagatacacattaactccttcaaaatcagggatatcatttcatagctgccttaagggcacctctgaaacatctaatgtgtttgcaaagattgatttagatgaagcatgaatactcccataaaatactaatattgactaattattccttgcttagaaatcatacatttaccattttatacccttgctcccttcactgctagaggtattgccatagatggtagaataagttaaatcagaatgtgtttccactttcaaatttcatcatctatcatataaagtacttgttttttgtcatattttgctatgaaattattaatgctggtgggcatgaataaaatatgtcatttgtatctgaactagtaatatgaatcttagagaaatgatgagttgctgaaaagataattggaacgagtggaataacttaatttatcatattatgaaatttatttctgggcttttaatctttattcgtatacgttggctccagatataatgacatatccatccctaccattacaaattattacttctttcaagagaatatattttcatgtgacttttgttttataactaaagggaaaatgaaaatacgtatatataaaacatcagttcagaaacattccccatgctatataattaattctaagtgatatatgcacagaaaacggagaccatatgtggtagagaggaatctgacgaagtcccccaaatactcctgttttctggttattcaaacaaacactaatctagatgtctgtgtaaagaaatattacagatggaattagaatcactgatcggctgactttaacttaggggaattatttagcattatccatgtgagtccagtgtaatcacatgggtccttaaacgcagaaaccaacgcagaatatttagtcagtagagatgcattggagatacgaggcaaaaagagaaaagtcagaggattcaaagtcccattatttctggctttgagggtgatgggaattagcctagatttatcgcctctcagagccagtagtgaaatgaaggccttaatcctatgactgtatagcacttatggaaccaaccacaccacactgtacctagacttgggacccttgtgaaattatacatttgtgtggttttgagctgctaactttgtggtaatttgttaccataacaaagagaaaataatattccatatttacttgccataaccaatgcttaagcaggcaaaccttactttttaaaccatgctttagagaagttatgccagtttgcctcattaacagcctcctttttagtaacattccggataatgagtgggctcatggaaatgataagaatttcaaggggaccccaagtggtcatatttattttgctattgagttcaagtattttcaatattgttaacacaaatgctgcatccagattggacttttcataattcacacctcacaatgtcacttccccatcatatcttttgcttaaacgctttcaacgacttttgacctaaggaaaattgggcatttttaaaaagtccatgcctgatttcacctttatctgtgtctccagtgccgtacttcattcctctatgattccttgcttggaatattgtctttatatcttcaccactttacccacttgatacctagaagcactgtggtataatggttaatagggtggactctggggttattctgtcctaatttcaaatcctggccttaccacttccttgctctacaacattaggcatgatactttacttctctgtgcctcaatttatttatcaataaaaccgggaaaaataataatacctactttagcaagttgtcatatgcagaatttactcatttgtgtctcctccattttttgtgtactttcatttttttctcttacacatttaatgaatatttatttctataaataagtgtctatgatcctagacataatcaggagatgcaggtataaatttgatatttttctcctcataggaccaagtaactattcccatagctgcaaacatagattacttataactatttttttcattcactgaaaaaacatttattatgtacctactgaatttcagaaactaaggatacatatatgaataaaatatagttacttatctattctattgttaactatatgtttgatggaatatagcaaaaaatgtagtaaatctggtcaaattgtcatttattgataaactagaaatatttcagccagtagagttaggtggatataactagaatttaagcaaacttttgcactggaagaatcttttatttttacaaacttgttctattgagtgtttgtaatatgtgaagcacattatagaattataagaaaaaatgcatgtgaagcacctaggataatgcctggcatataatgagtgtttattttaaaaaatatatattgtttgagcccctacaaagtgctaatcattttctaagaaacaaggacatatcaggaatgtgataagattctgttccaatggaagaaaaacttgttgagcaaataaaatgtgcatagcttaatagcaaccagcatggtttaaaacacatggatagcctgagctacttttgatatggcatcagggatgatttgggagaggtgacaattgatctatctcctggggcccagagattgaaaaaaaacaaaaacaaaaaacaattgcttgcaacttaatccttagtgtcgtgcccctttttgttcaaaaaaacccctttcccttttgtaattcattgtaggtttttcttctcaattaaagttatgtcagaaaactaggcttaataatttagcttagtattccatatgccaaactgattagttcatattatatattgtcatggttaatactgagtgtcaacttgattggattgaaggatacaaagtattgatttgggtgtgtctgtgaaggtgtagccaaaggagattaacatttgagtcactgggtcgggaaaggcagacccacccttaatctggtgggcaccatctcatcagctgccagcgcagctagaacataaagcaggcagaaaaacatgaaaaggcgagaccggcctagcctgtcagcctacatctttctcctgtgctggatgcttcctgccctcaaacatcggactccaaggtccttagttttgagacttggactggctctccttgctcctcaagcttgcagacagtctattgtgggaccttgtgattgtgtaagttaatacttaataaactcccatatatagatatagatatatatctcctgttagttctgtccctctagggaaccctgactaatgcatatatgtttatgttatttgttctcatgtccaccaaaaaggtcaattaaaaaaaccttcccttagctgtggtaataccacacacacacgcacacacacacacacaaaaccttcccttagctttggtaatatcacacacacatgcacacacacacacaaggcatgcacaagcgtgcacgtgaacacacttaatatgtactttttaaatcctcttttacattaatggcctatttattttaaaacttgagctaattttcagaaaatcaaattttgcaagtgttgctttgtgtgtttaattgtatcaattaattactgtatttgcaaggtttaacagcccaaaagctatcaaagaaagaatcattttaagagcttcaagttgctgacacttctaaggcaaaactggaaaagacacaagctgaagaatgattgatttcttagggatatctttctgtcataaacccaagatatttgagaaaggcatgctagattttattcactgcatagtgcactgccaatatcaacattttaaaagcttgaagatatgaaaagtagaattgtgtatcaacagtaaaactttacaaacatcctacaacttatattttaaatacaataacttttaaaggtcctagcggtcagtgggaattgagagttattttattcggtggttcagaccctgtgtttatgcagaaacgatcttctagtaattttaactgtagtgagctttctaatgaaggctgtgcaaatattaaacagctactacaattatgcttcggttttcttttcaatattgaatgtttacattcttaaagcatctctgatcgatagcttttattgactgtgttttctccttcctcagctatttctttacttgttttgctttattcatttcttcatatggtatgttatttatttatttcatgttgatgtgggaaaaaagttgccctctttttattaacagattgaattatcagcaggcactgaggcttagtgccaagcaagaaagacacagacaagcttattttttctgctaccactttgaaccttgaatacagacctctgggtaatgtcacactggatacttgctgaatatttgctgaggacttcttttatgtttgtctcagcattggtttaaaacaagatcagggctaagaagagccaagctgctcttgcaaaggtcttccttcatttgccttttctctcccagactttccagcaactcctgctctcctgcatattgatctgtgacttgactctggacttcatgtgttcatgtgtttatatgttaactacttggtgatttcaatattttttacatgatgcatgaactcagcatgaccaattcaaacctataatctctcgacacaagtcttcaaacctggtctacttcagtgtaatcttatcaatgaatggagaaacatgactgtccagctcttacacaagccagaaacccaggagtcactttttgaacaactccctccctctctcattgttcgtattcattcctaaatattctatgattacccacttctccccacctccatggccatcagcactactcaaaactaaatagtcactatctgttttctggagacgggagtgtcctaactggttaatcctagaaacttttgtgtctctttacatggttttcacactggatttatctaaatagatatgaaatgatatcatgtgctccatctcatatatgaaacacttcaatggattctcattacaatcaatgtgacttataaactctacaatgtcttagctcctttttacagattctgcccaaaccacattggaccatgtcaattttattataagacttcaccatatgctatttcttttacctagaacaccatcgttcattcataccctcaaacacacgagcacacacacacacaatcatctttcgcaaagttaatttttttcttattcattcatttgtttcagaatcccattcaatgtgttcttccatgggaaaccctttttgacctctctaactagaccaatttcttttcttcaaagcacttatcacagttgtaacttcacatttatttctagaatttattagattctgagctgaaatttccatgaagggaggtaccatatttgcttttgctcaatatctgatccatgccatccagtttatcatctgacacataatatgtatttgataaatgtttttggagtgaactgcctttagttcatgtgaaagaaatgtaattcatttttggcctaatagttcttcaggcaatcccgagaagcatcatacttcccactctgacttggactttctcacttcagaaataaaatgacctgaatttatttaaccattttcatgttaaatatttagtgaccctttgtcatcctgattgtcttgccctgcacatgtttttcatattctatataaaatatagaaaactctgaaaattgggtgcctagaaatgaacccaattctctaagtaacaagcctttctttttttaccctccatacatcactgaagtccatgttcattcaattttgtagatggtagattagctaataaaatagccataaacatttctattataaggctaggcaccctaatctgttttatcagggaatttatttacctttttctgacataactcccagtttgttttagtttacacagtagttctgtcttacccacttgagtcaattatgactaaacttagaatcatgaaccccaccacagaatatctcattactgggttcttttattttgatttttttcttgttcttgagatgaggaaaggaagttaaaagaaaccaacattatttctctaaaacttccacaaagatcaaagttgaaactggaacatagctttcctgatttatagaccagaattctgaaaattacaccaaaggtggctaataattagaataaatcatatctgtaagaggctttaaaaaataagtattctgtttttcacattattttttcctattttatgcccattatccaagatgttgtttcaccttatctgagttagaaactagcaatcagtagcaaaaaaaaaaagaaaaaaaaatcctaaactaactttttaaaccttacaatgtatagacttgttgtactatgcaacttatatcatgttaagatattaaatgaacaataataaaatataagagttgaaagtcaatttactcaatcattacataaaaaatgaaatacttctaaatttttaaaacccttagattttatgtagctatgaacatttagaaaaactatgctatgcttttaactgggatccctctatattggtacccctttcaaattccttttttttttttaatagaaggactcaaaccacccctttctatttctaagcctcccagcagcaattgtgagaatgtatgccacaccacccatatgttcgtctccagatggctagcctgcttctctcagctcccccacctgcctgggccaaaggcatgctgtgcccagaaccctgtgtataacatgaaagatgctgatgcctgctgtcatccatacccttgcatgtccacagtttaatccgagcacaagcaaggaaagaaagagaggcaaagctggaaggaagcagaattagagttaaaggagagggaggatggaggaagaaaagaggagggaaaaaagagagtaagaaaggatgcaaggaggaaaaggttacagtgtgatgagaaaagtatagttattttatgagagtcaatcattattttggtaagattaagaaaattgatattgcacactcaaaaatcaaataaatagacttaaatttagtcacatgaagacaagcacaaatggtttctttgtgtaacattagaattgatgctgtgttgtactggctctgaaagtggatggtaagctgcaagtggttgttcgtctgctattctctatgaaagacacaggtaccatcctatggatttgagagaagtgtttcacatctaatgttactgagcaataacacccaagattaaaaacataacagaaaacacatacatgttgctgatgcatatgggcatcacgtgtgtgagttgcaactcaagcagaaaccctcagataaaggagggcggtcaaaaaagttataaaggagattttccttctttctaatgtttcttccctgcccttagcccagtgtatcttcaagtatgaccctgaggtaacccactttagagtcaccttgagtagtcaaggagacccatagcataaataattaatcagccaacaaggatctattgagtgatatctcaatactaagcaggtaatttgttcattcaacaatatttattgagaatcaattatgggtcacatactaagttcagcactgggatatattattttgaaaaaacatagttctggctcttttattcaactaatattctttgaaaacctactgtaatctaagcactgttttaagctttaggaataaagcattgcaaagaaataaaaataaaaatcattccttatgatgtggaggttcttgttattgaaaaccataataaataaataaatgagtcatttgtatgaatacattatgcaaaaagacaaaatgtgctggagagaaaatagagcagagaagggagtatcaggagcaagaggtatgcaatgttaaatagagtggctaataaagccttttctgagatgcttaaacttgaggaaaaacttgaagatggtgagggagtgagccatgtagctatctggcagatacctggaagaaatagccagtgagaaaggctctggttcaggatggtgtctgtgactgaagagtgagtggaacaagagagagagtggtagcagatgagaccagagagtggcaggatacctttacaatggcctgcaagacaccacaaaatctggtatcttgtaggccattataaagtctttgtcataacttgtctaaatcaatttgtattgagggatccacccccatgacacaaacacctcccatcaagcctcacctccaaccttgggaatcaaatttcaacatgaggtttggaggagacaaatatctaaaccattgcataagccctccccgaatccctcccttctttagagtgaaagccaaattctgctatatagaaaaagcctgaacaggactaaattggaagaagggaaagcaggtgggaggcaattgcagtaatccagtgagagaggatgaaagtgatggaagtgacagagttgaaaagatgtaggtacattctagatatattttgacgactggatttatagaatttcctgataaatcagtcttagaatgagagagcaagagataagtcaagttcgactcaaatctatttggccagagtagctggaaggatggaactgccattaattgacatggaagtgtggatggagaaggatttcacggaggaatgttaattattgattctgtttcaacaggttgattttgagatcctagtggagattttcattagtctagagttgagaggaatagtctgaggtagagttgccataggtgatattttaaaaaattagattggcaaagatcccaaaggtacttagcgtcatatcaagaaatgaggaattacaaagaatgtgcaatagggtactccatattagaaggtcaagaagcagagattattccaccataacagactgagaaagattagacattcatcgaagaataaaaaatatatggtgtcctggatgacaagttaaaaaattatttcagagttgaggacatgaaaaacaaggtcagaggctagagaagtaagaatgcaattattcgatcattaatagaagaaacaaaaggttaataaaataataggtaagtcagatactgttaataatacgaattaatataaaatataaaactaaatgctacaaaaagtacatcattttataataataaataacaacaaatataaggatagtggcggaaaacatgggatgaggaaatgcttgtttaaagaagtaatcttgagattaaagataaaagatatgtacaactcactgaaagtgaaactgtgaaggttttggagtgttacagccagatcagatgacatttgcaatggccttttttggaagaaaacatagtgtattcaaggaaaaggaaaaggctagtttagttttagcattaaaaaaatgaatgtaccaacttaaataaggaattatgtatgtttggaaagaaaagtcttgaaaatcatgggcaacataaaccaagatgagaattaaatgacattatgttagttaggatgttttgggcaacaaaaaagaaaatatcggcataaaaattacttacaaaataatagtttatccataagtctcaaaagagacatatggaaccccacaattctatatctcaaaagagacatatggaaccctacaattctatatctcaaaagagacatatggaaccccacaattctatatctcaaaagcgacatatggaaccccacaattctatatctcaaaagagacatatggaaccccacaattctatttctggacatctatctaaaaggactgaagggtgtgccttgaggagatatctgtacaaccatgtttatagcaacatggttattacaataacataaaggtggaagcaacccatgtgtccatcaatggatacatgaataaacaaaacataatatatataaacatggaatgtttgttattcagccttaaaaaggaaggaatttctgacacatgttaaaacacggatgaaccttgaggatattaaacttagtgaaaaagccagtcatagaaaacaaataccatattattccacttatgagagagagtagtcaaatttatggaaacaggaagtagaatggttgctcccaggggcttaagttagagagaaacagtgagttactacttaatgggttcagagcttcagtttcgcaagatgaaaattgttctagaggtagatgggtgtagtgtagtgtacatatgagtgtacttaatgcctccaaactctacatttaaaataggctggtaaatgttatgttacatgtatttcatcaaaattactactaataataatgaaaggggtcactggacccaatgaaaaagaagaaagaagaggaggaagaggtgaaggagggcagagagatgtaacaccagggatgattttagtaaattcatgatacctgggctccaggtaacttctgcatgactcttttagtcttcccttcgtggtcacaagatagctattgaaactgagcatcaagtttttccacaaaaatgtctaaggcaggaaagaagaatcagggacttttttctcatacaaccctttctttctaccaattaatagaatatgtttctcagaggccttcaaccaagatcactttagtgtaattggccagaaccataataaaattgccatacttgtctgcaagaaaaattgtgaaagaaggtttctaatgatttcagattcactttcgagggcaaaagtcagtggtgtgctgatagatatttaacaaatcactatctgggacgggagagaatgtgtgtacatatataagtgtattatacattttattgatataaaagatttgtgggacactataaataataatagtaatatataaagtattctttattgtcaattttgtatagccaaatgatctacacagtgtgcgtgcttccattgattttttttccatgcttttttatccatagccaaaatatagttgcaattcacaagtgtagttccaacaagaatggtgatagatattttcctcgtagttaatgagtgatacgcagtgaaccaatgaacacatatataaaaacttagtgtgagtaagctttttcccaaatcttctgaataccagaatatttcctcaatttttttgcactatttacaatgtaacagctattgatatgatatacttttaactttaatctctattactaatgttttctccaacacgcttaagtctaaacaagcgacaggagagtgccaagactggctgactagaagcagctgatgtgcaccactctcatgcagaggagaaagagtagcaagtaaaggctggcccttcagctggatatgcaggtagacatgctgggattcatcaaagaagcaatatgacctacacaggtcagagaggagcaacataggacagttgcccacccaggattggcatggagcaaggggaggctttccactataggaaattgtgagtaatagcccccgaaagcccactaccaattggagggccccccggcataggctgatcactttcattggtagtggctctgcatttctctgggagagagcccaattaaaaggacctctgcctcttaccgctgctaaggacctgctgaggaaggaacataaggcccgagcttaccccagggctgctatgtgcagccaaggaggaccaagccaagatctgcatccagcactcaagtgagatagaagcctacacttcctgagcactgagagggtatcatggctgcaattgtgaggaaatacaaagaagtcatgttgctgagcgtgagcctacaacatggccattacacctaagcaccatctactagatcacagcccaaacttcaacaccaaaaatacttttccaatatacccccaatccactgcaatccctgtcctgtgaaaccaaggacaagaattcagctacaaatggagacgctgcacaaagcctcgtccctcgggaaacatccagaaatgaagtcaactgacttcaacacaaattccaacacaattgaaggaacatcagcccacacagatgagaaagagccagagaaagaattctggcaactcatatagccagagtggcttatttccttcaaacaactgcactagttacccagcaaaagttctcaatcaggctgaaatggctgaaatgacagacatagaattcagaatatggataggaatgaagatcatcaagattcaagagaaaattaaaacccaacccaaggaatctaaggattacaataaaataacagggctgaaagacaaaatggctattttaagaaggaaacaaattcatctgatagagctgtaaaacacactataataatttcataatataatcacatattaaccgcaggaatcaactaagctaaggaaaaaaatttcagtgctcaaagactggttcttcagactaagtcagacaaaaataaagaaaaaagaataagaaggaatgaacaaaatgtccaagatatatgggattagatagagaccaaatctatgactcattggcatcactgcaggaaagggaaagaaaataagcaatttggaaaatatatttgaggatattgttcacaaaaatttccctaaccttgctaaaaaggccaacattcaaattcaagaaatgcagagaacccctgtaagatactatgcaagacgaccatccccaggacacataatcatcatattctccaaaggtgatatgaaagaaaaaatattaaaggcagctatagggaaggggcaggtaatatacaaaggtacctccataaagctaaaagcagaacattcagtagaaactctgtaagccagaagagattgcgggcctgtattcaggatccctaaagaaaagaaactccaatcaagaatttcatatccagccaaattaagcttcataagtgaaggagaaataagattcttttcaggaagcaaatgctaagaaaaatcataaccactcaacctgccttggaagaggtccttaagggagggctacatatggagaaaaaagactattatctgccaccataaaaacacacataagtacatagattattgataatataatgcaatgacactatcaagtctgcataatatccaggatcaaatccacaacatagcaatgttaaccttgattgtaaatggaataaatgccctgattaaaaggcacaggggagccagttggataaagcagcaagactcactgtgtgctgtcttcgagagatctatctcacatacattgacactcacaggctcaaagtaaaggaatggagaaaaccctaccaagcaaatagaaaacaaacaaaaaaatagtggctgccattctaatttcagacaaaacagactttacaccaacagtgatcaaaaaagaagaagaaggacattacataatggcaaagggttcaattcagcaagaagacataacacaacacaagagcagacagattcatagaataagttcttagagacctatgaagaaactcagataaccatacaatagtagtgggaaacttcaacactccactgacagtattagacaggtcattaaggcagaaaactaacaaagatattcaagatctgaactcagcatttgaccaaatggaccttgcacacatatacagaactctctacctaataacaacagaatatacattcctcttatctgcacttggcacatactctaaaatcaaccacacagtaagccatataacacttctcagcaaatcaaaaaagaaactgaaccaaccacactctcagatcacagcacaacaaaagtagaaatcaacaccaagaagattggtcaaaacaacacaattacatggaaattaaacaacctgctccttaatgacttctggtaaacaatgaaattaagacagaaatcaagaaattctttgaaactaataagaacaaggatagcacataccagaacctctgggacacagctaaaatggtgttaagaggagagtttatagtgctaaacacccatatcaaaaatggcagaaggatctcaaattaacagcctaacatcaacatcacaccttgaggaactagaaaaacaagagcaaactaaccccaaacctagcaaagtcaagaaataacgataatcagagccaaactgaatgaaactgagatgtgaaaaagcatacaaaagatcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtccaagctactcgggaggctgaggcaggagaatggcgtgaacccgggaggcggagcttgcagtgagccgagatcccgccactgcactccagcctgggcgacagagcgagactccgtctcaaaaaaaaaaaaataaataaataaataaaagatcaacaaaatcagaggttgtttttttttttttaagaataaataacatagaccactagctggactaacaaataaaaaagagagaagattcaaataaataaaatcagaaatgacaaaggggaacataacctttgaccccacaagaataaaaaaaaccatcagagactactatgaacatatctatgcacacaaaatatatgacctgcaagaaatggataacttactagaaagatataacttcccaagactaaatgagtaataaattcaaaccctgaacagaccaataatgagttgaagtacggaatcagtaataaaaagcctaccaaccagaaaaagcccaggatcagacagattcacagctgaattctacaaaatgcataaataagagctattaccatttgtactgaaactattccaaaaagttgaggaagagggactcctccctaactcattctatgaggccagcatcattatgataccaaaactggaaagagacacacacacacaaaaagaaaacttcaggccaatatccttcatggacatagatgcaaaaatcttcaatgaaattctttccaaaaagtccttgtttttttgtttgtttgtttgtttgtttttagaataaataaatccaacagcacatcaaaaagccaatctactacaatcaagtaggctttatccctgggatgcaagattggtccaacatatgcaaatcaataaatgtgattgaccacataaacagaattgaaagcaaaaaccatatgatcatttcaatagacgcagaaacagctttcgatataacccaacatgccttcatgataaaaaatactcaacagaataggcatcaaaggaacatacctcaaaataataagaaccatatattacaaatccacagccaacatcatactgaataggcaaaagttcgaaccatttaccctaaaacctgcaaagggtgcccactcaccactcctattcaatatagtactggaagtcctagccagagtaatcaggcaaaataaagaaatgaaaggcatccaaataggaaaagaagaagtcaaactatctctcttcactgacaatatgatcatgtacctgaaaaaacataaagactgcataaagccttctagaactgaaaaacgactttagaaaatttcaggataaaaaaatcaatgtgcaaaagtcagtcacatttctatacactagtaatgtccaggatgaaaggcaaatcaagaacacaatcccatttacaatagccacaaaaaagagaaatatacaggaaaatagctgaccaaggaggagaaaaatctctgcaggtagaactacaaaacactgctaaaagaaatcagagatgacacaaaaaaatggaaaaatattccatgctcattgattggaagaatcaatatcattaaaatggccatactgcccaaagcactgtacagattcaatgttatgcttaccagtcaaggccattcttcacagatttagaaaaatctattctataattcacatggaaccaaaaaaatgagctggaataaccacagaaatcctaagcaaaaggaacaaagctggaggcaacacaatacctgaatttaaactatactacaaggctacagtaaccaaaacatcatggtactgatacaaaaatagacacatagaacaatgtaacagtatagagatccccaaaataaaaccacacatctacaacaatctgatctttgacaaagttgacaaaacaagcagtgaagaaaggacttcctatgaataaatggagttgggataactggctaaccatatatagaaaattgaaactggacctctttcttataacatatacaaaaaacaactgaagatggattaaagactttaatgtaaaacctaaaactataaaaacccttgaagaaaacctagaaataccattctagacttaggcctttgaaaagatattatgacaaagatgctaaaagcaattgcaacaaaaacaaaacttgaaaaatgggacctaattattaaagagcttctgcacagcaaaagaaactataaatagagtaaagagatagcccatagaatgggagaaaataaatgcaaactacatatccaacaaaagtctaatatccagaatctataaagaacttaaacaaattaacaagcaaaatacaaccccattaaaactaggcaaaggatatgaacatacactttccaaaaaagacatatatgcagccagcaggtatacgaaaaaaaatgttcagcattactaatccttagagaaatgcaaatcaaaaccacaattagataccatctcacaccggccagaatagctattattaaaaaatcaaaataactatagatgttggcaaggtaatggagaaaagggaatgcttatatacatgcttttgtttggaatgtagtttagttcagccactgttgaaagcagtttggcaatttctcaaagaacctaaaaccaattgaggcagaaatgtcattattggatatatacacccaaaggaatatatattattctaccataaagacagttgcacatgtatgtccatcacagcactatgcacaatagcaaaggcatgaaatcaacctaaatgctcaacaacagtaaaccagatgaagaaaatgtacatatatatacaccctggaatcctatgcttccataaaaaaggaatgcaggctgggcacggtggctcatgcctgtaattccagcactttgggatgcccaggcaggtagatcgcctgaggtcaggagttggagaccaacctggccaacatggtgaaaccttgtctctactaaaatacaaaaattagcctggcatgatgcatggtgaaaccctgtgtctactaaaatacaaaaattagccgggcatggtggtgcatgtctgtaatcccagctgctcaggaagctgaggcgtgagagtcgcttgagcctgggaggcagagatttcagtaagtcgagactgcaccactgcactccagcctaggtgacagagcaaggctccatctcaaaaaaaaaaaaaaaaaaaaaaaagaatgcgatcatgtcctttgcagcaatgtggatgaaggtgaagaaaattattcgaagcaaacttatgcagaaataaaaaaccaaatactgcattctcacttacaagtgggagctaaacattgggtacacatggacgcgaagggaacaatagacacttgggcttgcttgagggttgagggtgggaagagagtgagaatcaaaaaactacgtatcaggtattatgcttattatctaagtgatgaaataatctgtaaaccaaacccctgtgactcacaatttatctatagaaccaacctggacctacacccctgaaactaaaataaaagttaaaagaacaaaaagagcaaagaatttggagtcccaagacccctgggacttattagccgagtgagattgagaaggacattcacttgttttaagtctcaggttccttatctgaaaggatatcatttgaaaacagtacacatcttacagggctgtgatgaagactaaataaaactgttgacatactggaaagttttgaaaaatgtacctgacttcaaagactgaaatttcactgcagaaaaaaacttttaaaaaatcttcatataaaaaattactttaaaaaaataagcaacaaagcaataactcaagacttcatttatagcattggcctatttccacggagtaaatactcccaatatatccaatttcctggtacccacttgacaccattgaatgtaaatttgagattgtgcaatagcaaaacattctataggatttctaatattaagatataatcaatgcaaacaaactcaaaagcataggcaatagtaagaggtaataatatatttggaaaggatgaattttgagctttaattattttgcatttaatgtaattaaattgttcattaatatagtttgatgtttaatcatatctgtttataatatggcttgcaaaattcctgaaaatttaacaatcagccctcataggcctctttggatcaaatgaccagcaaggcataatactagcaagtaaggaggaatgagatggctttggctttacagattttaaacatttaaattcacttaggtatatagtagaagcatttttacttccaattgtgcttaatctaaggaaaatagcatctttgaatcttttcctttttctaatcaacttttgctcctaattttccattctagcttctaatatccctagattaagaacaaaaataacattgatttccaccacagataaaatgtccaataaaaggcaaagtaaaactggaatcaattgaatattctctgtttaacaccaaattgattttaaggctgccagataaggaagggagaaatagaatgtaaagctgtcctgagaagagatcactcagtctaagcccctcattttgaagatatgaaaatggagatacctcaagattggcctaaaatcaccgaacccactagcagcagagcaaagacaagaatgctgggctcctgagttctgaaagccatacctgttctattgctgtgcaccaaaccttaattcctgggccatctttattagaagagtgtttggcaagttctttgggtgtgaaaagagaaaacagttctcataaatcaggtttccatgcctggtctgttaaatccaccactggcacgatcacagggaagtgctgctccagctcattgtgctagaaataaactgaggtctcatagcagccattagagtctaattatatgtgacagccaacctgacaggttttgtttatttgtttgtctattctttcagtgcttatggcttgaaaaaaatgaataatgctgtcaaaactatcttacccttcaggagctctttctctgcttcattggaaagcataggaaagcatttacttctgacacgcctggtaaagctaataaggaaaaatgatttcactgagaagtctgtataattatgcatggctcatgtgacacctactgatggtcaactgtcactagtacactgtgatatacttgataagagaatgagaatcaggagcatcaaatacatagaaatcacataagaagtcttttcggaagaaatgcgagctatgaaatcatctgaggatgaggcaacagatatatctagaaaacatgagcaaaataaaacataaaattgtataaatttcataatggaactagtggacaattgacagattatatttaaccctgtcttaatttatttttcccagaccactcaccttttaagaatatcaacattatatttgtactgaaagtagatgtgataggtagatcttgattattttcgagtcccaagcagatctctatgtttttcttgaatgattccaattttaccaatgatctagctaaggacattgacatgttcctgaatgcctctaaacaaagtaaaaaaaaacaaacaaaaaaaaaaacaactttgaatggcagtattaagatccaattccttatcaacatgttgaaatgataatgtgaacttaataaaatatagtaagactcaacatattaaacttaagaagagttaaataagtaaaggaaaacaaacaacaacaacaaaaagctggagtggggaaaatagaatctaatagccatctgtatgagaaaagattttatttggctgcaaactcatgagttgatgttgtaacaagactgcaaacagcaagaatgtgaatatattgaatcttgccttcctctgggaagtgccaatgagagcttgtactagctccactccattccagactggaaagatcatgcctagtgtgccatcagcttgagaaatatgtgtttttatctcccatggctttgattaagttgggttacatctggctactactcagtctcagtttggacagtgtgggctccacagcatttgtccactcctcatttacttgcagaattctgttgtctaagttacactttttacactctgttctaatgtggctactggtgaggtgtaaacgttgttttgccactgtgaaaaatataaaaataggttttacagtgctccattgtatatacttttatatacatagtgatttctagaactaaagctttctacattattaagagttgattgtactgtgtttaattgtaggcaagacattaagtggtatgtttaaaagttgggtgtgcttacataagaatccccaagaagagaaagactctgtaaaccaatatctatgaggaatagttgaaaaaaataaagaagacttatttatgcacaagaaaaagagaaaaaattagtgggtaattcttaatggaataattacttagaagatgaattgtcattttttttggaattcagtttatttttgtgactgtcaggatgaaagttgcaaggtcacagattcaggtcagctttagagcaggttgaagtattagaaaatggaatatgatgctttataatcaattttccattcatggaggtgtccaaagggtactgaaatatacatgtattaacagttttataaatgggagtgattaattagatagtcttctaatcagtgagttacaatattcttttccactgcaagaatctatgagtcaatgttgtatcattgatgacatgatgacaaagaagctctatacaaccttcattttggttattttaatttgtaatctctcatttgaaacatagcactgattgaaaggtattttaaagtattatccctaccactcattaacacaaatcactcaacctagaagaacgtgtggtggctgtttatagacctacacctactttttgatattaatttttccttctagattttcatatatttaattagcttacaaacaactcacctattaaattataaaacttatgtatagatttgatatagcatagtttttacataagaatgtttaataatgaagagtggtgtttaatcaacatgttgaatgtgaagccaattcataatttgaaaggtcaacaataaaggggcatcatccatcatgatttaatcagtcgtatcttattaagagcagttgcaaaacaggtgagaacattcacaaaaggattagtttataatatttaggttaacatttaaaaaccatcactagccgtagtgttcatgatattaattatatagaagtatgccattttctaaaggagcaggaaaacttttaaaatattaacaacactgagattagtcttcagaaatttaaaataaaattcaagtgtctttagaatttaaatttctttatgaggatgtcaaaatgataggataaaaccccaatgaaagatatatattgcaatattcatatccaaatgaaacttctcagatcatgagtctattaccatactccattatcccgagatgaagcgattacatgttctgtttttatttttcaaatactgttgactgccaaaaagaaactagtgaagatattctttatgccaaatttccttgtcttctttcattttttcagtcaaccaccatttgctaagcagcactatgtaccaagtgtcagttactctgccactatacacatttctgtgattcaaattagctcaaataagatccacaagtaaaggaataatgtttgtattatacaaaatttcattggtttacctgtgattttcataagccaaagtagccagatgagtgtgaatagattacaaccttcagtgggaaaggaaaaagccatcatcttagctactgccctggcagtgggagtcctttcagaacattccaactaagtgcaagcagttggagcttccttcccagccaagttcaccatcagttttgttcagccagtggtaagttgcactatcttccaggtttacttcaccagcagccccactctctgagatctccattttcatcgatttggactcagtactggccaaatcttcttaactaatgttgtttgtgaattactaaaatcatctgtggcaaccttcagctacactaagctgcctgcctaggtggtctaagttagctctgcagaaacttattactgtgtttgcttgtgctttggttaaaacatttacataagattttctttatcattgcctactattatgcagaatatgaggtttcctaataacatatataattacagagaaatgtctctattgtgatagtcgcaggagattcagaagtgaattatacgcagctgatgccttcacactgccaaggtttagtaaaaatgacatgcaaactatgagttttactacaatgtgatgagtgtcattgctatgctaaaaaatacaagaattcagaggttagaaggcccaaataccatgagttttactacttccctaatagctcatttcacaataaagaatttctgatcatcagaagcttattatattgaactagaattttcacttctttatgcaatcaacaaggacttattgatcagtttctataagtcaggaatgtttctggacaactggagtttgcttgagaaggaaaattggacctgacttagtgttacagagtttatattttagattcaaagattgaaaatcaacaaacacacaagaaaataaatgaatctgtgaacaaataaaattgtttcagatagtaaggaaatctctgaaggtaaacagagtaataggacagaaagtgaccgtgtagattaagggtgtcaatactctataggctagtagaagttaagctcttctgtggagaagtatgggtttcagctaatggaagtcaaggagagatttacagcctgaagtcaccaattatgcagagccttcaggcagggacattatgtttggcaggagggcagacatgggaacactggctgcttgggaagataagaagaagccaggcaatatactagtccttaggaatttggatttgatttggcatgagatagaaagtcactgaattgtttttagcaggaaaaggacatgagatgatttattttgtgaaaatataagttgacggccagatgaagaaacaattgttaggttataggcatggaagcaggcagttaggtgttgggagacaatagccatgtgctaagtgaggcgttgcagtggtttgacagggaaaacaggggccatgagcaacagagatgaaatagataaactagagtatattatggtgacataatgtgtacattatatcatttggggatagatggaatgtgcttgtgattaatccacaaccatcaaagtccaccaagtaaacaagaacagttctctgcatctccactccattactgatgtggtttggctctgtgtctccacccaaatctcatctcaaattgtaatccccacgttcccaggttccaggatcacgggggcagttcctccatgctgttctcatgatagtgagggagttctcacgagatatgatggtttaaaatgggcagtttcttatgtgcacactttctgtctcttctgctaccttatgaagaccttccttgcttctccttctccttcctgcatgattgtaagtttcccaaggcctccccagccatgtggaactgtgagccaattaatcttctttcctgtgtaaatcagtctcaggtagtatctttatagatgtgtgagaatggattaatgcaattaccttttttcgttctttgccctcattcgctgaggttttcaaactacaattagatgaaaactttttgtgactgttacagaggttttcctgcctctatttagacattggaacaagattacctttaaaagggggtctagcatatgatatgtagatgggaatttttaaggaatatgattcatttagcagcatggactattagtaaaaaaaaaaaattatattaaatggcattctttccatatctatagggccaagtcgaaagctctccattatagctggagatgccctctttaagcttttacattctccttccgcccccaacatacacgctatacttatacacgtatacttttcaaccttcaacctccctttagaaaaataaaaattatcattaagtgctcagatcaaaaagtaataggcaatgaaaaaaatattgatttgtattaaatcaccggtgcaaatatggtgtgcgaggataagaatgtttggcaagagctacagtattataaaataaatgatatgctagtcatcgaaggcccttgtccatgtaagtgagcagaaatatatagcatttgcttattatctccagcccaagtagtaaattatcactgaaatggcaaagactgaagtggacataaatttggggttcgctgtgctgaggagtgtgggggcttggtatatttcaaaagccttaggaggctaccgatcatcatgatctgcagacagagctgcagataaagtataaggtgatttctagttggaaacttaaccaaggctctcatggcttacagttagaaaattattttcctctagtacagagtttacagattaccttttatttctttttagcttcaaacctattgttaaaatatcaaattatttgtattttcctactctctgtgaaagaatctttttaaaaaattaacctttctaccatttgattttgattacagaatgactgatttactcattaattacctattcattcctacactatagcagatgctattctaggtactagagagtgatgaacaaaagagatgtagactctgtatcagagaatttataatcatgtaaatgttataaagatagtgaaacaaaaaatgactcataataaaataaaataggagtgatgacagaggagaaaaatttaacttattttgaatgaaagtgtgtttgcataaggtaaggtacgtatgtatattggaattaactcagtccaggaagtggccgattttagagaacatagttgtcagtttaatctcctgatattgcagttagcgtattatctgattgtggctattagcttgcaaacagctgttgtttagccaaagcagaagccatatagggtttgcaaggttgaagacagacctgttaccacttctagtaagagactttcaaatatatggcctactgatggcttggtagtaatttcagcaaaaaagacaagtcctgttttcctcccttattattctcctatagattcagcactatctgttcgcagtctttgtatcaaggctgttctatttacattccatgcaaaagatgtttgttttcttttcatggtggtgatggctaatggctccctccattgtggcaataccttccagtgtcattccctatccttctgctcctttctctgcctcctactcccatgtagagtttctccaagagcagacttacttgattacctcagaaagccaactcctgtaatgtcacagaggcatagtactctatgaaactaagacgatctaagacacatgggagggaaatatgactggaaactatatttgctggttgctactaagagcctcactcagtttccagtgtctttctggtggttttacagcttttttttggtaacttacgattgtcttctctagtacccttcccaacaaaagaaatgtaggatattctaattattttgcactcattaaaatggacattcattttgctgaaatatagcttattctatatatgtttataatgaattatcttgtataatttttttatcttgacctatttttgtatgtgtaatgtcattcttttatgggcctgtgcattctctttagcattctaattcccattctagggaacaaattacagcacctttgtgttttaatcatcaattatcctactcaagtgttttaagcaccctgcaaacaatatctggtatgtgccttgcctagtttaattattgaagcacttttgaaagcaccaggatttcattagtgatcaatataaattgggccagtgttcaaccaatttgtgttcattattaaagccttcggttccaacaataacttggagacagagaactgatgaagctggttagacaattgcctaatgaggcaagcagactctgcctctgaccttaaccagcctctgggctctgaaaactttaaatggtcccagtgacagatatcacactagaaatcagccattgtccatctaatcactacctctagctgagctgagaggcataaaataacacaaatgaattgaatgaaagacagaatctatcatgctacaggtaattgtgtttatcaagcattaatatctgagactcaatcctagggctctaatccatctcataaaacaaagtccagagacaggagcaatcctcggcaaagaagccattcgtagaaagtaaaatttgtgggatccaaaaataattgacataaaattccagcaaaacagactgacattccaaaagcactttaaaattacaagggattgaggacacagatcttttagcagaaggtacagattaaccgggtcttcgacacatgcacaggatgtaggtgacgtgtacaactggagttaaatggcagttgagacaggtaggctttttctagttggagagctctcagggaaccggtgaccactttggtctggtacagatgagagatatagaaattatatcaggtgggaagtagacacctggccagggagaaatgcagggacataattaatcccatttctgctgagggtgacaacctgattagtgcccttaattaaggtcaggctttgagtatctttataaattcttgctatgggagctttgtgccaaatatatccatgtatatgtatagatagttacattatttttccctacatcaatttcatgatctctaaaatgaactgagagagatctgatttgaaatagtattcttacctgttctcaaaatctgaaagtccaggagtccatggggaaataagatagagtttttattacatattgaggtatcataactcttcctcaacatggaaacaaagagcttgcattatgtcaggtttgagcttgttagagacatcatttcagcaggctttttggattctgtgttggttgctactgaagtaaatttgcacagtactgttagcctttgggggtctttcttactcaaccactatagttgttgcagaattttgtgccttagttcagctaaaacctggttcttgtcacacgaccaggaaaatttggacacgttgaagggtgagtagagcaggattttattaggcaaaaagggaaaaaacctcacagattaaatcccaggccaccacacagaaactgaagagaccaggctcctcttgcctgcccatggctccaccctgttcccccagtgcacatgtgggcatgctccagcaaggccctgggcagcttccctcatctgtgccaaagcctctgatgtaaacacttatggagcaggtcggaggttctccagggttccctttttatctgcttaggcattcggctatctcgtagttaagattgagtagatctgggcaagaaaacaggggaagaaatggatataaatatgtgcctttcatcttcattaatttgaagcctcaagtttgtataagtatgtttccccaagggccttaacatcagatgttatgtaagtaggattttgattattcagaaaataaacttaccaagttaaacacagcgatattaccttgatttggaaaaaaatcatttagcaatggaattcaattttataccccggtacctaatacatgattccacagggaatcatgcttgattctgttagaaatactaatctggatgtaagcacttgccttcaaggagctttaaactagtggaatgtaaaaaaatgcactagaagataatgtagactgtgagggaaaaaaatgttatgtgatagagatgagtttcagttagcaagattgggcagattttaagaaagagggggtatttgactgaatcttgaagcaaggatagatagaacttcaactgacgagtaataaaggctcaaaggggaatagcatttgtttcattaatgtgctcctagagctcagcttgcataactcattttttataagactaagtttatgcttaaaaactcaccgatgtcatcaaaaatctaataggaatatgaacattttctgctagtggttttggtctctatgttagttctatacttttttttttttttgataagaagtatggatggtgggaaaccaactgctttgatggaaattcaagcaacagacagatcccctgtcagctccacacaaagatatcctgatgaagttctcctgacttctaggagggaatgtttcggaagtgcacatgagggagaggaatcctgctgtcagctgactttttcctttgcttactgtatttgttttgttttgttttgtttttaaaacaggcttggacatacattttcaattcgaaaactcccttctgagatccaaaagtaaacatgtttacagattatgcaaaagtttgagtttagtttcagaatttttctctcaaaggctctagcacaaaaaaaatgggggatgtccaaattctggaatttgaaacaaataacaggacagattgcaagctggcagctggcagggagaagtccattatttcccagctccattcctttgacttcagcctagggaaaggttaccctaaccttgcctcaccttattacccattctatttttaagcatttctcatttactgaaaaatatttaccacatacttctagtggatctaatcattagattcttaggtggacgcttctcaatcaatgaaggacagaacctatcgagcttcctgacctctttagttcctaaaacgcggcattctgttttctctttttactactaataaaggcagttaacattcactggtgggccacagtgaaaacttcagatagttttctgaaggtttactactttctatttagttttgttctttttttttccctaaaaattagtgggttccccagtttgtgtattgtaattccctttttttgagtcttgtttttcctcttcttctgtgatttctactcattcccgaaactctgcatagtaatcatgaccaaatgatttctgaattcatatatcaaatcccccaaaggcttaatatcatctcagaatgtcagccaagctcagatttccaaaagttttatattattacattggcttgaatcatagacttgtgtccttctgtagtcagcacccattccttcacctttaggcatagctccagttctgagagacctatccttgcctctactgacaacagcctggtagggatatcagtaaatgtagccagacatgtatattgccacatggctgctgcatggccctgattaggccatcttgatctgattgaaacaaagattagaaatagtagaagttgattcattccaaatacttgatgggacagcacatcaaatcccacagctcagacccctggagctgctctggtctgtgtgttttctaagcatacctttcaaaccctccctctgtttctacaaaaccctgtgtatttttcaaaggaatctctttttatgctaggaagaggtggtctctattgtctgcaaccacacacacacacacacacacacacacacacacacagatattctcaacaagtagtttctacaatgttgataggcacattgttagagatggagttaaaaaatcaattcctgagtcctaaatataggcaacttttatttcaatgaggacataatacatccataccagagatcattataataccatgtattggtaccaggacctggaggatatattgaggcatcttcctaaaacttcaacctaagttgctatctgagatttaaaaccaaaacttaagggacaagacataagccgcctcatataataaatacaggacaacttctttgccatcaggacataactgaaaactaaaacacatatttgtcaaaaggtgtgttggtaaatgttggaagaatagatttgtaaaagtgaagtttggaagttttcataaaagaattaattagtagagaggggagtaccttgaccaatgagcttcctatatcagaggaaggcagatgagacacaataatctgaagtctaatgcagtttgttcaaatcctggataacttgcttaacctgtctaggtgtcagtttccttagttataatttgaggataataacagtataaattattattagtttattgtgttgattatatgaaataatccatttcctatagtttttactgcacatgggttaatataaaatattatcaacttttttactattattattgagttggcaaagttattcctattatgggaaaagattatcagacattttagcccagtgccttacaaaatttggatcttatcattcttttagttctgatcctgggctcatgaagcaaccttctgttgctaactggcatcctacataggcctgccttgagggaagaattgctctgctaaggccaattagtttctaaggaaactctattttaatacataaaccaataatttgatttttttttaaactttatagatcagatttatttggagaaaacaaaacaccgacaacccaaaggatgggattttacgtcaagacatctcccaggtaataagtctacagattaaatcattttcatggaagatatttttgtacaaattttacatgtattcaggagccggacattaatcaatccctgtttctattttaaaagggaggacaaagtaggggagggggaaaacagttttggatataactatttggaaggagagtagacatgaagagggcaaaccctagcttttcattatctacaaccaatgttttttttcttttaaaaaaaaaataaaacaaaaacttttcaatcttcaacactctttaaaagcccacttcttagctactggccaatccacagcaattatttaattcacttggtacacacctttgtcctctgggtaaattatattcattatgcccactgctgcagcacgcataaaccaacacccctgcatggctgaacagggcctaatctaggactgatgggagaagggcttgcaaaccaagatcaaggtgtcgtttctctgctaatactgtctacaaagctgatccctacaaaaatgcacataaaagcaggcaagtttatctactgtgttgcaagggaaaccaggactttgttaaatagttctctccattaccatttgttctctcaagggaagcttaaaaaaaaaataaagaaaaacagcacattggtctgcccccctcatgaatccaacaagcattggtgtggcatttcagtggagaaggaaacttggggggaaaaagcccatcaaggttgtaagaagactcccaatttaactgtccctttccctatttatccaccatccaagaccatccattattctagagcactctgatctataaaaggggtcaaagcatcaggagcaggcaaggagtgagaaccaaaagacatcaagaaaccgatttgcttgagaaaagcagcgattcttcctttcatagctctccatggctgagagagaaaatgcccgagacatcatgtatgtgacttagagactgcttttcgggaggttaaaagtagcatgaagagcttaagatgacgataagagtctaaatttttagtttcaaggtttcagtagaatgtggatatattcaaactttcaaaaaggacagtgtttagaaagggtaaaactaggacacagaaaacattgggaattaccacgacctccaagtgcttccggctccaggaaataaccattcatgtgtttgctggaggtcacataattttcccctattacctggtgcagaatgactcatcacttcccaaaagcttcttttcagtccacaattttcccatttattttggtgcaatgcagtcccattctttatggcctaccgtctcactcccaactaccctcctgggagtaaaaaaaaaaaaggaattccccctaggctggcccccaaaactcagaattaaataagaggaggggctggcagcctcctggagactaaaacaacttgaggctaaatctacctttccaagggtggaaaatttattcagataatgtttgagaattcatatatgccaccataggataaaaactaaaaggtagaaatctcacacttttccttctacctccctcccatactgcccaaccaggttccaggcgttatatcactgtcattaccacttctgctaaatggagacctctagtttgcttttataaatcaaacttgtgattttggcaaatgaatgccagccttttcatccagctcctagaggtaggacatcctatggtagacacaaaccctggggccttgtggaagcgtttaaatggctgaagcatcaaggaagccttctgagaaatgtttaagagttaaccaggtcaaggagataatgaagttctcactgccaaggtagtatagggcaaacaaaaagcttaaggtgtcaagatatataaacagaatggggatgggggtggtgtcatgtgaggggactacaagtacttcagggttgctaaaataagagttaaaggcagatacttgtaggagactgggcaaaaagtctggctgggtcagtatttaattgtatgcccccccccaaaaaaaattaataagctgaaatcctaaatccaaggacctcagagtgtgaccttccttggagatagagtctttactgagataattaagttaatgtgaagtcattagaattggttcaaattcaatatgactgatgtccttataaaaaggggaaatttgggcacagacatgtatagaggcagggtgatttgaagacacacggggacagatgaccatctttcttccaggctaagcaaagggacctggaatagatcctttcctcatagtccccagaaggaatcaaccctttcaatacattgattttgggcttttcacttccataattgtgagttaacacatttctgttgtctaagccactaaatccatgaaactttgttatggcaacccaggggactaattcagccagattttaaacctctgtatgtatctgctaatgagcttataccttctttgcatgataggaaagcattgaagtgtgtgtgtgtttttttaatgtgtgatatgagaggacttggtgtttgtatgcattagtgtgtgtgtatgtttatagatcattatgatatccctgtggaagatggattcctggagactaaatattcaagtcaaggacatcagttagaaaattattatgttaatccaagtgagttattactatgtgcactaagggtaagaaaactttaatatcagaaggactcaggaattgtttacaaaggtagtggaatgacattcagatgggctagaattggagccacactctcgggatgtgtgttatcctctgccacctgctagctgcgtgaccttgagcaaggtacttaaccttcttgatcttgatctcatttctttacagtttgtctgtccactgaagccaacaaagtttccaaatcataaacctgattgtcatttcattttctcttcttaaaaataaaatagtcccatggcgcctgctcttaaggggctcacaagtgggacaagatttccttccttccttccttccttctttccttccttccttccttctttccttccttccttccttctttccttccttccttccttctttccttccttccttccttctttccttctttccttccttccttctttccttccttccttccttctttctttccttccttccttcctaccttccttccttccttccttctttccttccttccttccttctttccgtccttccttccttccttccttccttccttctttccttccttccttctttccttctttccttccttccttctttccttccttccttccttctttccttccttccttccttccttctttccttccttccttccttctttccttccttccttccttctttccttccttccttctttccttccttccttccgtccttccttccttctttccttccttccttccttctttccttccttccttccttccttccttccttccttccttccttccttctttccttccttccttccttctttccttccttccttccttctttcctttcttccttccttccttccttccttctttccttccttccttccttccttccttccttctttccttccttccttccttccttccttccttccttccttccttccttccttccttccttccttccttccttccttccttccttccttccttccttccttccttccttccttccttccttccttccttccttccttccttccttccttccttccttccttctttccttccttctttccttccttccttccttccttctttccttccttccttccttctttccttccttccttccttccttccttccttccttccttctttccttccttccttccttccttctttccttccttccttctttccttccttccttccttccttccttctttccttccttccttccttttcttccttctttacaccccatttttctttaattaaagtatctaaggctcaaaaccccagcccaattttactctcatccctgacatgagtttccaatcacgatagatactaatttaaaagcacctttcttgagtccttttcctttactttaccatccatctgtatgatcagtctgtctttagtcactcctggcttccaatgagtgatttcctctatacaataatgttcaacagcttttcagtatctgttgcattaaatgcagaatctcttttttagcattctagatcattcatcattctaaaacacctttcaactttatctcccattcttcccctttgtattccatctgcattgatcaaatgagattatctcatcactgcctgattctacgcagtcccctctcaattcatgcacttcttctccattctttcctatagaaattctacccattcaacagggtccttcctaaatgccatttccaaactaaaatgttctctgcattagggtactttctcagtggtgtgtagtaaacatttactcagacttgaatgagggaaatgaatttactggcttaaataattggagagtctgaaagttattttcagttttctctaagtggtgtgtgtcttagtttcctgttgcttataacagaatacctaaaagtgggtactttatacagaaaataaatttatttcttgaagttatgaaggacaagaagtctaaggtcaaggatcctcatccggtgaggaccttcttactggtggggactgtctgcagaatcccgagaaagcacaggacctcacatgagaaaggatggagcatgctagctcaggtctctcttcctcttcgtataaagctaccagttccactttcatgataactcattaactcattaatcagtgaatggattagtccattcatgaatgcagacccctcatgacctaattacctcttaaaggcctcacctctcaatactgcaatattgagaattaagtttcaacatgaattttggagaggaaaaatatgcaaaccatagcagtggggaaaatggctccctttccccatctctccatgcagcagctctaggctacaatttataagtgtagaagaggagtgaaactattatttttattgttcagaaaagaaaggaaggaaggaaggaaagaaggaaggaagggagggagggagggaggcagagggagggaaagaaataaattccaattggctctacttgtgacagatgatcacctgggccaattacttttccaagagatttggaaagtctgattggatagcttggataatgttgagagtggcatggcttttgattgacagcccagacaggaacagatgaagtgacaaagaggcatttataaaacaatatgtagaaaagataggagtggtttggaatctggtgctgcttagtcaatggtagaagtagagacagtggtctgaacactgccatagaaacatgtgctagaacgtttattggctaattatatttcttatcgctgtgtgcatgcccctgtatagtgtgactttaccatatctcagttaagaggcatttcactcccttgatcctgggctggatttgtgatttgctttgaaccatacaatctatcagaagagacaaggtatgcaatccagagctaggtccccagaggccttggagattttgtttttgatgccttaggacactgccctgacattaccatcccaatgagtaatgaagacagatagccactgtcccagcagttccagttgagcctagtccccaagcaacccaccttctgaatgcagcacaggtgagcccagcaaaagaatcactcagccaaaccacagaatcatgagaaatgatgactagttattattttaggacactaagtgtggggtggtttgtaacatagccctagaaaactgatgaagaacaggaccaggcttgcactcccaggagagcacgaagaaaagttctcaaaaccgatcagtattactagtgtgttttggaaataaacccaatgagaaaaaacataggctatttattgagagtttgttatagcaagaaagtcagccaccatcacttgtgtttgggcagagactcaaagtcaggcagaggagtagaaaagccttagagtggataaaaaaggaaggcttcagctgtgccttggtgacagggtattggcaggaggaagctggaggtgagctgactagatacagggtccccatgtgattgattggggggcatatttatctatctttgtttggctctaagttggaagtggggtaaaaattagagaagctgtcaattaaattgtggcctttttgagccagttgtggcaaggcttgttgtttggcttcctggactggttgctgaagaaagtggtccgacttgtggcctggttactgtaactagcaggttaggtgcctgtgctgttgttgcagactatgagtcagagttctatttttataggcactctaattattgtccatttgtctattccgtttcttaatatttcactttgttacaaacagaaaaaaaaaacctctctctgaattgttcggaacatgaaccccagaatgggtttaatcaagataaactaaactgtgagaagaagacctttataaaatgttcattaagatggaaagatatgggtcaggagagctgggagtttgagtcctcgagggcacaggagtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagaccttattgtgcacaagcaatatgtaaatcattgtttatcagtgagagcaatgcaaaacgtatgtgacatggagcttccctttaaggaatggttagtctggcagcctcgtggacactaaagcatgcctataaattcctggatatgatgtaaaaagtgataagtgtggtaacaggcaataggccatgggaatatggaagaccagaatattctcctttctctttagaaacatgggcaatgatggcacggagtagaagctgttaagaagaagtttaaaggaggcgtaataatggagctcttaaaaaatcaagtggaggacaagttcaagggctaaaaagggactttgggatctggaaaacaaattattaaagctacaggataaaggttaattggttggagtgttgagttagctgaacaactgaaaaaaaagtgaagagtgctagaaaaaaatatcagtttcagtcagacagtggaagacattgaatgcctagataagaatgctgacatttattctacatgaaaatgctcacaaagctttcaggaagtagaatattattcagaacagtgctctgaaatgaacaatcaagcagtggcttttacaacagataggtctgaggtaggttgtaatggcaccagataataattcattggcaaatatctaatgggggcaacagaaacgaatgagaagagataatagatggcctcaaatttccaagtatctgaccagataggggctgagaactgaaaaaaatggaaaagagaagtataaaatcaaaataccaaagagttgttgctaacttcacaataaagagccaaaagttatcactccatgtaatttcaaaagcctgctctccccctgtgacatcctaaagggacacatggaaataagttttgaaatggcatgtggccatatgattcattgtcatacctggaaattaggactcagagttatgttttcttttctcctttttgctatttctttgaagagctttctacaacccaaatactctgccagttttccaatgtatttgtgaaatggtgatcatgattttggctaccctcatgtggatttagagaagaaaataaattgaattcatttctgcaatgcacgttgaggatttcagagattttcttttatttgaagaaaaatataagcttctaaaatactcataacagccaaggttgggcaactgaaattgccttttgctctgcggagactgcgtaatatgagctggaaggaaaaaaaaatgatcctgaaacctgaggtttcacatcaacaactgaaaaaaaaaaatgtagaacataaattgtagttttcttgcagaatatttataacagctcacttgtagtactccggtctctagctgaacagggccaatggagaaacatttctcgattcagcgttttgtttgatccttactacagagtgattgatcacagcaatttctttcacataaacaaaatcctctagacaagcttgttggagacactcagggctatgaatacactgcagaccaaaaactaatattttgcttgctgtgtttaaactcagtgccaatagggctcaaatcacttgtatcataaaagcaaaactcttttaagcatcctgatttaattaggttccagggaaagggcattgcctaaacatgtttctcctgtagagaggtatctgtcttttcattagagccccaacatacaagcaacaaaacgtatggtttaacacggtgagcatctttaatcattaggaaactatccagcaactagctcagctacctcattttggagagcagagagccgtatcgggaaggaagagaaatggaggacagcatttcccgtgatcctgaacatgttctcatattgatgatggtcgtttctgccgccggagtagccggaattgtaatttgagaggagtgtcattttctgcagatacaaaccttgtgtaatcctcccatttaaatgacatgatcctgcaggctgatgatttcatggcccacaatttgtcacctccccactgcttgagagcgaaacggtagctaaacgacaatcaatagactgattttgtcatgcctgactgttcaccttgtttgaactaatttttagtttgttaattgtgttttaatatgccaccaaagggggaggtgatcattatttttttttaaaaaaaggaaagagattgtcaaatgaggtgaggagagggtgatttaagtgggatacattacagaaaatctataaagtcacccctgctccctggagtaatttccatagaggaaataaactagttacatttaatgtttgtgtgcaaaactgattttttttacttcttgttaatatgctttattttttctatcaggattcaaataattgtaactatgtaaacacctatatatgttactatgaatagatttttgtagtttcgatatggaaatataatttttcagagatagtgagcattcagttagtcactgattcatgtgtggtagaagtcatgcctggtaagatgtcatcttttctgtttaagaatctgtaagtagactggaaaagaaaggtttcagagtttttttgaatatcatgctttttggacaaagacaaatcttaaatataaatagactttaataaagctttaggacccattaattaaatgtcactttcaagatgcagaagtgaggctgaatgcagtggctcacaccagtcatcccagcactttgggaggccaaggccagtggatcaattgaggtcaggagtttgagaccaacctgcagaacatagcaaaagcccttctctacaaaaaattattttttaaaaatttgccaggcatggtggtgcatgcctatagtcctaactacttgggaggctcagatgggagaattgcctgatcccaggaatttgaggctgcagtgagtttgatcatgccactgcatgccagcctgggtgacagagtgagacccctaatctctaaaaaataaaaaataaaatttaatttaatttaattaaatgatgtagcaataatacagattagggtgtgggtgcctggattacctctgagtgaaggcggcttctggaggttcttaatcccccagtgattacagtaatcggtagtgtccctggaagattaacatactatggtatatgtcctctttgaaactgtttctttcctcttttgttggtatctgaacattaatatctttaggatgatgaccgcattcatcatccaaactgagaggcttttgaaaatgaaggaaaagagttattagtatgtatcctgggaatattgacaaaaactggggcagtccccaccaaactgggatgtatggccatgctaaatatctgctctctggactttcaggtggtatgatatgaaaattcacccacatctttacataaatatgggaatcgtacaactggttaaatagagtgtttctatatatggtatggtatggtggcaggtgtgacagaaaaaactagaaagtgaagaaagaagcatgtgaacatctttgcataaagaaactgcctagactttattactcatgaatgtaacatattagtgatttccagaaactagatagaatgaatgatctctaatagagaaccctcctcccccaatggttttgtatactattttctcaggatacttaataatttctttctaaactgcaaatgagaaaatgaagcataaatatggtcttgactttggcacacccaattatttgaattgttggtatcattttaaaataaaattgttttatattcctcttcctaaatgattcaacctcaagaccaattcaagtgttattcaaataatttgaatatctttcacttcatcccttaagaagtacaacaaacctatggttgggttgatggagagagattgatgtcatgccccgacctaggaatcagaggtgctagctaggctctgctcattagctcagagactagaatgagctgacctgcctctctattctaccagttccacttctaagggagccatttgctgaatagctgtgaccccttatttacagaaaattgcatctgtaaaatgaacaaatgtaaaagcaaaatgagtctgaaccagcatctctgactttcttcatatcatcaattttatgtttaatttttatatatataatcaaagttattatttcttctattgaataagtttttactattaggagctttgaatttgttgtcacagttgaagctataaaaagttaatccaggaacatttttgtaatgttactttttccttaaaatatttgaaaccttatatatctgatatacccatctttcatttttttaaatttcctttccattttgagcagaatcagatataattccttccatcctctcttcttttatcccttacttcacacaaatatttatatagtgtttactatttttcaggcactattcttggcacttgggatatattagggaataaacactaattccactgtggaggagctaatgttctagtggaaggaggaagacaataaatagggtaaataaatattgcaggttagacaataagtgtggtgggaaaaaaataggacagattggaggattcaggagtactgggtcaagacgtgagagtatacatttcaattttaaataagataagccccactgagaaaataacattcaagctacatgatattgtatgagcaggagctttttattttgcaatcagctgtattgtttcacatggggaaaactagagatgaaactcaataatatgacatggttgagataataaaataacaaaaaatgtataatattgggtgctctggtaatgactttgcatgtgtcattttatttaatcttcatgacaatgttatacaattggcactgttatctgtctgtgaggaaagtgagaccaacaataaccgacttgccctgggtcacacagatagtaagcggtgattccagaatttgtatctaggtagtctgattctaactctactcccttaattactagccatgttctcttgagttctttcataccaaggaaaatgtcgctattattcctgacgtatcttcaataacctcaataattattttgcactgtgtagggcctttgaaaagatggaggacacacattaactttccaggaaagatggtggtgctcacatttgataaaatgagagtttaacatcaggaatgaagaaggcatgagacttcctcttctcactaaaaatgggttatgcgtgattaggtgtttctcacccactcttaagagaaaaagcatgcatgattaatatgaatgggggttcaagtgcatatatcaaagggagaaacatcctcttgcattttaaagattgcaaataaatatagtttaatctgctatacataattcatattagcaacaaccacctcaaaattaatgtcagcccatgttaagatttgtgaatgacatctctaaagctttgcttcaggctattctcacagagactggttaatgcctttatggctaatttcctgaggcttatttttttggtctttcctgatgaaatattaagctctttttaaaaagagatttatctgataaaaaagtaaacccttgttcaacccgttacatagatttttctttaagatagggtgaggctttgcataaaaattgaaaagattgcagagggttcagtaacactagaggatctatgagatgtttttttcttattgaacttgacctcttactgttcagcacactctaaataagggatgttaatttcactcccaaacatactttattgctttggatattgagaagactgttaatctgctacttaaaaaatctcagaaggcaggaagtaattgcagaatttaacactgaacaatattaaactctaatttgactactcattctgatattaggggttatttcaaaagtaaagactagaagttctaagagtaaagagataagagttgtgtgctgtatttattctttcctcttcttttgggaagatgccagcaccccttcagtaacaacgcaagagcgtcttttcagacttctctttgcttttggtaaaaacatttatgtgtgtatcgaaatttgaacattctccctgaaatggtactcaaggagatttctaatcattcaaataatctcctaatttctcttatttccacctcaacgttcccaggcctttcctagctctgttctttttattttgttttttttactgtattggaggaaaaaatgcctatcttcactgccaaggccaacacattcatctctgccagagcagcattcacttctagtttcctctgggacattactcccttgggtacctattttcttactggtgttttttcacctctctttctaatgattcaaatcagcttccaggtatgctcagcctccctaccctaatatcataatccttctaaagtattttttctccttagtccttttctgccctctcctctctcttctcctcttgtattttctcccctgtgttctatccctcctctttatttattttccctcacttgattgccaaacttctcaaaagtgcaaactgtgtctactttcttagcatcctggcatatgaaacaaccatggccttggaggtaagatgactgggatttctttcctgattctatcttctggtgtgtaactttgacaagggacctgaattctttggcttgcaaataccgtattatatccctctagtttccagtgatggttacacaaactaatagatgatagaatcacatatcatttctcttggaagatagcaaattttcaagaagtaataactaacatgtattcttcagggtacacccttctcctttcccctaagatgagctttttaaaaatatcatctggaaaggagaagaaatagtacaaaagaataagtaaacattaacaaaaaatactgagtgtacataatacataacgtaacaaagcattagatgcagggaacttgggtcacagaatagacattagaaattccatttcttttctcagagctatgatgctgtggcaatacatgtaggagaggcaaagtgatgagagagaaccagaagcagactaagatgaggaatgtggttcttctaggttgtcctattgtgatagatggtctcacaagatgtccacaattaagtttattcctcccatgttgctccatggaaagatgggttttcttcctctccccttgaatctagactgcatttgtgatttgctctgactaatagaatatggtagtagtgatagttccaggcctggactttaaagggatggtggcttcaggatcctcccttggcagtgagatgccatgttgtgaggaagtccaagccaaccacatgcaaaagccaactgggaaaggagagatgactggctatcccctagtggggccagccattatggctgaggtactgctcatgtgaataaagacacatcttgtactttccaggctcagaagaaagtggagcagaaggactatctggctgagtcagcactgattccccaatgattagatataataaagtgttattgattcaatccaggaagttttgaggtaaatttttgcacagcattagataacagacacaattactaatgaaaccagcccaattgtcccatataaatgatatttacaggtttttgaatcaacatagaaattgatcttcctcatcttaaaacttgaaacatatctgagttccttcctaagaaaccaactctggggcaagggaatgagactcagcagatcaccgcatccagacaatgaaatgccagacccctcatccatcatgattgcttccttacccctccctaattcctctccacacatagctacatcccttccccactatataaatccttcaactttagttgtttggggagattatttgaaactgatctgtccctgtggcttcagcagctgattaaagccttcctccctggcaacatttgttgtctcggtgattggctttctgtgcagctagcaatgagacttagactgacactaacactaatatacttcagcaagtcatctgcatttgctgatccattctaatttatcaaatgagacaactgaactagctcattgcaaacatgccccacccagcctgaattctggccatccatcagttttgcatgtgcaagtatttttactgataaaagttagaccctgagttcaaaaagtcttagaacttcactcttatttcctttatgacttaagtcctctctcatctgtctttttctactttaaatgaagttaatatcatggatcaactagattaaatgagatagtctatgtaatacataattctggaatgtgataagtacaccactttccatgaaagctcttattattaatgaaagaaagaggaggtcccacagcctgacccagagttgtgtactctgatccacaccatcagtggaaaagaaagtgccgtttgtgagttctaaagataaatgctgtagatgttttccaacatggtgacatctctgtgtttccctccttaaaaacctgataataatcttcatacttctttggaaaacttaatagaatgtaatgtactgaggcatcacatccttagtccctcttaaattttctttgttagataatcagggcagagtatcagaagtaattaaaattaaactctgcctgaaaatatgttaataaaaagtatgatatgagattataagtattgttaagcaaaagttttagaactatgtagaaaaaaaagtacagaagacagtgttaaaaaaaaagaaaggaaggaaagcatggctagataaaaaagctgaagaaaaagttaaaggacatatggctctgtagcccactacaagtttgcaaaattcatttctttttgtagacacagcttgatataagctgaatcctgacaaattattctttgtattcagagtcacttaatttaaaacaatgtaaattcaaaggaagaagataatgttcctaacctcactgtgaccccagtccaattttgctacaccacctcaagcgagtcaaattcacaatttacatgcaggaagttaaccacaaaattagagcaactctttataggccccaaggttaagcatcaaaggcagaaatccaattaaaatgttatttggattttccaatagcaaacaatctggaaaacttaccagattatgagaaggatatgtatatgaaagctagagattatgtcttgcataaatcaataaataaaatttaaaaatgtttattcatttcttcaacagagatttatatttttgcagattacatacaagattttttaaagaattgtggagaaaagataaaaaatgacttcagccctcaacttaagaagataataatttttaaaaggtagctaaaacattcaaatatctatgatggtaggtaggatattaaaattctagatgagtgatgcacataaaatgagacagctgtttaagggaggagaaactccttccaggtttagggatggtaaggattgcaaatacttgtatacaatatctaacaagtacattagactttgaagatgcacacatggcacaagcacattgttacacacaattcatattcatttatttcagtcactcagaagatatttgtgcatacctgcctagctttcacatgctgataagacagtctctttcccgagctgtataatatgtgagtgggaagaaaaggtgctttatttaaattaaaattaaactataaggctgatttgtaaaatataaaagcaaaaaacctcaaatgaagagggtagacagactgacgagttagcaaatagaatcatctatcaattaacagtggggacctggatgtcaagttgcccggtttgaatcctgaatataccacttcctagcaaagctgaatttagtcatctgtaaaattgtgataataaaattagtagctgcttcttgaggattgctatgaagattagataccgtagtcctcccttatccacggttttgctttccatattttcagttgcctgcagtctgaaaagagatgaaaaactacaacaagatattttgagaaagagaccacatttacataacttttattacagtatattattataattgttctactttattattagttgctgtgaatatcttttggggcctaatttataaattaaactttattatagatatgtgtatctaggaaagaaacagtagtatgtagggtttggtcctagccatggtttcaggtatttactaggggtcttgggaagtatctcctgcagataagagaggactactgtaatacagtgcctggaatatagtacgtgcctggaaaactgaataattgccgacagtattaagattgatgtgaaactacctagacctggaagggcttggtggaggttcaggaaagaagaaaatgtttgagctaagcttagaatagtctttggacttgctggtcacaaaagaagagctttgttaaaacaaggacactgttggaattagcaatcactaaagcttcaaaatcttttaacttagaaccattaggttctcactcatctttggaatacctctgagatttacctgcattggcattgtgttcatctttttcttgatggaatttaggctcagagaattttagaaactcgtgaaagtcagaaaggaaactaattttctaattttcaaatatgatgccttatacatcaactagagaaatatactctcaattttagtttgcgaggtagactcgagtctaagtgatcctttctttgtgtactacacataactagttatgtcactaaaagacaaaaataaggaaataaataaatatataaaatgaacggtaatgtctctaccttaattcccacatcagtaaaacaaagctaaaaattatctttgcctctatatttctaagtaatgtttgatataagtatgaaccatgacatcttaaataaaaacctgagagaataaatgatctaaggggtgcttccaaggaaaggtgttatataaatatgatatattttcattaatagctataaactgtgagtccctgagaggatgggaccttaagcacttctgttaaacctcaatgatcttgtgaagatgtgtctggtcatcacattttctataatacaaacagttaaaacaccaacatgattagaagttaaattaacgataattagaaaaggcgataccaggaattgatttagtaattcaccctctgagatatcacttgtattgtgttcagtttcttagcttacctattctattttcaagtaccttattatgagtttatttcacttccccccaaaataatagattttagctttgtacgtatttgaaaatttataatccatgttttgtgcatgtgtaactctcagctcaccaatatatttcattatctgaaacagcctaaatcattccatatatgtatgtattactttataaataatgcacatgtgagaaagtgaggagaggctgcagatgttcagtaaagtgcttggttagacgcaaacaatattatgactggaagaaactcaactaattatccagttcagggttggcaaatttttttctgtaaaggccacacagtaagtattttagactttatgggccatacggtctctgtcaccactacttgactctgccattgtaccataaaaatagccatagataatgcaaaatgagtaagcatgacatattccaacaaaacctcatttacaaaaacaggcggcctgccaaatttggccctagggctgaagtttgccattgtataaactaatgcgactcacctatttcacgtgtgaggagattaaggcatagaagatttaagtgccattattggctattattaattgaattttcatggggagaaacagctctgtctgctaacatttttattctgctttgtcaatgaatcaaccttccacaaggcttgctggaatgatctttatgaaatgcagagcaagacgtgtcttttctgtgtttaaattcctttaacagatccctgacttccatgtgagattcagtctccttgtctagcgtatttaggatctgtaatcatgagatttctgatcactgcatcgattccatagcctactccgttttgcaggaaggctctattaagcccccacagtatgataaactgcatgacacataggaagtggtcctattttatttactttatctcccatgtctaacataatgcttgatacacagtagatcctgaataaatagctggaaaatgaatggataaattaaaagctgagatcagaaaagagttttaaggcaaatttgacagaatacctccttgcttggccctgactaaagtttcctgggtctcaccacgtgttcatggaaaatgaaaggactaggatcagaaaccccctcccaggtgaccttcatcagagctcacttcatcagcctgtctccctagtaacccatttctatattaatgtctggttactcacagggccccatctgtaccgctccttaattgtgcaaaaatattccacgaactaagtaaggacattgctatcgtattatccagcatggttttcatcagctggtcacacttccttctgcttcttcaatgtctctaaggaatttgattctccaaatgttcaatttgttgtgaggtagcacaacctagagttacaacttgtattcctagggctattacagtgactcacagtaggagaggatattttgatacctggatcactgaacccacctgggatgctaatgtatatgtccgtgtaatgtgtggaattaccatcaccagaaggttgtcttccccaaggcagtatccccttcctccaggaaaatgcagaattgttatcactgtaactccataccagcagcatcctttcaaggaaggtctcacagtcttagccaaaaagagcacactgtgatgctgatgacactgtttttactaagctagacaaggtttctttttaaaaatattggccaccaaacaatgggattgtgctttcttctgcttttaaaagcatgattttttttaactatctccactcaagctattaaattaactgattaaacatatttattagccaaatacttcctaaatcatcagattgatctggagactattcagaagggaaaactttttctctacccttttacattcagtattggaggcctatgaattaaaaggacaaaagacagattagcaagataaaagataaagtatgttcatatacatacaggagagcctgcagaaaatgtagctccaagaagtggttggaatagcatctgaactagtgggatgcattaggatttcaagggacaataaatggtgagaaatgactgtgaaatatatgggggaaattaatggaaggtaagatttgagtgagaaagtcctgtttatgcaatttctcatcccagtacccacttctcctctaaggggacaggagtcactccacgtggtacaggaagacttccttaaagggggatttatgacagttgatccttttggaacacttggcttttaggcagacaacaggaatgcagagaaagctccttcctgcatgtttggattctcaaatgcctttagttcaagataatccttatgccacaatgacataacgtgaaccccttcaagaaaaatgacactccacaaagaagaaaatcaaggcaaagaattcaatcattctggaagacaaaccttttgactaaggtacccaaataatattgtagatgtgttcgaaagccctaagttaatgtgactaagtattcactttatttttcaatcaagcagagccatcttattgaaagttgaaaccaggaacactctaattgaatatctcctcccagaagattaagaatttcttattaatattttatctctaaatgaatcaattaacttctcagtacaaactgtgcctctttttaaaatatataatttggtaaatttattatccaatatagcagagctgaactttttgaaaaagaagggttctctgttagtgtgtggcagcatccataacataattagaagctcagaatattggggctaaaaggtgtcttggtaagctcagcaactgatccttggctttatagggagaaaaagaggcccagagtggttaactggtttacccaaggtcacatagtgagctcgtgctttaactaggacttgaatcttgggctcagtcccattgaaatacttgaaaagagtatctaatgacttgtaggttaatgaatagaagcacattcatcagattaatgcagcaaagccctggatattgagaaaacacaaaatgacttagagctaattaaatacagacacaaattagaaaatgaggcttaagacagaatattaataatttctggtagatatctcatctttctgctcttaaagcaccctatgctgtcttctctcacaacataatgtcaccttcttgatttcaattcattatgcatgggttcaattctgtgctaccctcccatttatatgttgaagtcctaacccccaggacctcggaatgtgaccatgtttggagatgaggtctttacagggatcattaatttaaagtgaggtcattagagtggaccctattcctatataattgatgaccttgagaaatttggatgcagagagatgcacagagggaaaacaatgtgatgagacatagagataaaatggccatctacaagtcaaagagagaggtctgacacatatccttctcttatgcccttagatggaaccaatcctacagataccttgaccttgaacttctagcctgcagaactgtaaatcaataaatcccagttgtttaagccacccagtttgtggtactttgttagtgcagttctagcaaatgaatgcacactatttactcaatttttccccaaggcaacccgcacttctaccctgcccagcaccaacagagatggtgcggacttctccttatcatctcagaaacttccagtgtctggcttttcctgggtactcagttagtgcctgtaactgaattgccttacactaaatagagtacttgtactactctaactcaactcttattcacaacagctccctactttgggtagagtagtttatattattcttatttaactgatgattttccaaagaagataatgacattcccatgtaaggttacaaagtattacaaaggaaagagatgacaatccactgaaatgctttccaaatataatccaaatataatagtccagtctttaaaatctgagttgctttttgttgaatctgaaactgcctttaatttaccacatgcagcttgaggggtctttccagtggaaactgttttccgtcagggaaaaaaataagtaaacaaataaaagccctcaaaactgatcactaaatcagctcagcttatcaaaacaaaacaaaagaaaatcccccaattaaaacaggatttaaaacaatgaattcaattttggaaaagaaattgccaagtttgatttgtactgattattacgtgtttcaacaaactatttaaagtagtggatctttctggggttttacagagctctgtgtccatagaaatcctgaaataaactcaaatttaccaattttgtattgttttccaagaggagtatccactaacactgattaataataacaaatggataattatgtcattttatatgttcttttgttacacataaaaatctagtatttcttaaatgctggctacatgctttatacatcagttagcactctggcagaaaataaaatggtttaatgaaaagagtttaactgaagaaaatttaatgaaggcacatttgtgcagagtgacaggcaaagtaagggaaaaatcagtggttggtgaggtacccaaggctcagcaaaagtgagaagctattacaaccttaggcctgaagatgtggggagttaccatcagagtccagaggaggattgtgggggatggggtacctgagagggagtgtagccatggaggaacacagccacttctagaagagtggtaaggcaaggcttctctctggtcaggaccccctatgacctggcaatcccacacagaagtcccagccctgggagcccagatgatacactctgtaaagctctgttggtctatttttgcattgctatgaaggaatatctgaggttaggtaatctgtaaagaaaagagatttagttgtctcatggttctgcaggctgtacagaaagtatggcaccagcgtctgcttctggtgagggctcaggaagcttacaatcatggtggaaggtgaaggaggatccagtgtatcacatggcaagagagggagcaagagagacaaggtggagtgccagactcttttaaacacccagaactcacatgaactaatagttagagcccactcattactgcaaggatggcaccaagccattcatatgagatccaccctcatgacccaaacacctcccaccagtccccacatccaacattggggattacattttactatgagatttggaggggatacacacccaaaccatatcaagagcttaatctccagagaccagttagacaatgaatgggaggggcagtttcaaatggagaacagagtattttatatgaaccatctaactgaataatcttcaaaccccatgacatattttacaaatttagaagcacaagatcagagaagttaaaaatgtgcccagtttttaatgagcaagtagaatgaggagtatattagtctgttctcatgctgctgataaagacatacccaagactgggcaatttacagaagaaaaagtttaatggacttacagttccacatggctgggggagcttcataatcatggtggaagtcaaggaggagcaagtcacatcttacacggagggcagcaggcaaagagagagcttgtgcagggaaacgcccccttataaaaccatcagatctcatgacatttattcactctcacgagaacaccacaggaaagacctgcacccgtgattcaattaccactcaccgggtccctcgcacaatacatgggaattcaagatgagatttgggtggggacacagagtcaaaccatatcaaggagcaaatgaaatccaactttgttttagatctaatgaagaagaacaaaagaaaaatattgttttgctttcatacaatacatttcttttaaatgaaggaaggggaagagggcattatgtgaaacttgagaaaattgtagatgagttttatgtcaaaggactttgtgtttacttcagaatgtggaatgacttgacttggtgtggaagaggagcagagtcagtgaattgacaggaggatggagaacgtgccagacgagaaagtaatggacatatgttgataaggatgatcaaagaccaaagaatgaggcctgcccaggtggtgcatgcctgtagttctacctactttggaggctgaggctagaagattgattgagcccaggggttgggtcccatctaggaaacatagcaagatcctgactcaaaaacaacaacagcaaaaagaccaaacctcataagaaacagaaaatattaagaaatgagtgggataggaggttaaacaagataactagctctcgtataacactatataatttactaaaattttagtatagctcatatgacttgatactcaacagatccttgagagatctattataactatttcccgcctcatgttgtagataaaaaaacaagttcacagaagttaagtaaatggtagatatggaatttgactgctagcctgaagattgtctaatgaaccaagaataattacttgtttgagaagtctggaagtagtctgtgatatgaaatgtcaccaaactatgatgcaactctgtgagtactaaagtagaaatttagttgtttttagtcatttatctaatcaaataactatttctaatcaaggtatgctagctaactatgtattccaaatccttttaaaattttttattagacaccttgtgccccaaataagaaagctactaaacatgagtatagcccagggctttgataattttcattagcaccttagtttaactaatgcattatctgttaaataagtctgattaacacttctctacataatcattttctaatgcgtgcaactgttgcctctagagattaattgccaagcttttatgttcaactaacagtagattgacatttagcatcttagatttatagatttcctggtatgttattggactgttttctttggatggattcctccaaccatttgaaattggatttctccaaggataggtcgatgtaagcagtggagctaatcacatcattttacttcagcctcttctcacagaacttggtttattatgatcttaaaacctcctgggatatttttctagctctggatgtatctgaatgtaccaggtaaaatcaggactactgtaattcatccatttgctgtactatcttctcgttccatatagatacctttatgttgacatgacagtattagaaaaagacagctaccagagccctgcccacccatctacaaggtcaagaactattcccaccaaactattgaggccttgtatatactaggtgcttaaatgacatttgataacctggtttattgactttgaagaatactaatttagttacttatttaatattccaatgcacaccttcttcaggtaaagtgcaatgttggctattgaggaaaagataagtttgtggcttcaactatgggaatagtgttttagttcaaatcctttagtttcaaaagagataaacctttcaaactcagttaaaataatgaatgaaattaagtggaatcaaaggcaaggagtacagagaggtcattgcttctctgaacctaaacattattgtcattgtttctctgcatagctctgtgtttctgtgtcaatggccatcactacatttgattctataatatttctactgcaatcaagtcactaacataggcaaaggttaacttgttccaggtcaaaattcctaggaaaaagaatctgattcatccaacctgtgttaaaaattaatacttgatacaatcaactgctgccaatggatctggctcccgtaataaatcctcggccactaaggacagctgggtagaaatgactattatccaggaaagaggaacacacctggccaacccctttctttctgtagtacatagggtatctactttgaccagtttctgagagtagtttgcttcaactctccctcttcctctatgactgatggcagacaatctaacatttaactctacctctgtattagtcagggttctctagaaggacataactaataggatatatatatatacacatacacactcgtatatacacacacacacagatacatatatatatatatatatatatatatatgtaaaaggagtttattaagtattaactcacatgatcacaaggccccacaataggccatccacaaattgaggagcaaggacagccagtctgagtcccaaaactgaagaacttgaagtctgctgttcaagggcaggaagcatctggcataggagaaagatgaaggctgggaggctaggccactctagtagtttcacatttttctgcatgctttatattctagtaaaactagcagctgattagattgtgccaatacagatcaagggtaggtctgcctttcccagcctactgactcaaatgttgatatcctttggcaacatcctcacagacacacccaggatcagtccttttcatccttcaatccaatcaagtttacactcagtattaaccatcacaagtctacccattgtcaacttgaacccacacacatctcctgagctcatacataaccttcaaataaagacaataataaggtcataattacacctaacataatacaactatcttttgtacaactggaaacacaccaatacccaacccaaatactattacagaaagttaacaatacttaaatgctgctatgaggtcaataaattttatgtcacatgataaaggaaaaaggaaataaaatgaagatattttcttagtacaagtatatatgtgcacaaacatgtttttaaaaaaaggaaggaggaaatactcaagggaattacagtccttgtttctgcagctggtcttgggatcatagctggtattgatgactaccttcttctactgcccattctatattccctttgccttcagcaagaacctcagcaggtcatggttttgttttgttttgttttctggtggagtgacccaaacctttattcctgaagggtgtgtgccatttgtagtcctgcctggattgggctgttgtagtttcccattgaccttaatcagagggcatggtaatactaagagacgccctaatggatctcctgtattccatgcatactctcccttacctctgttgtagagtggtagatgatttcatcttgatagtctggatcaattgccccagccaacactgtaactcccttcttagcctgttgacttaaaggtaggaggagaccaaagtgtccaggtggcaatcctaacttccagtttagtgggatctgggatcgttgttgtgtatcctggtggaagtgttcctccctctggaactaagacctctagcccagcagaaggtaatattgcaggaacaggaagcaaaaattttgctagtggatcacaggggtgatggtgagtggtgccacttccacttccaccccttgattccaagacccatgaatcctggctatgggagaaacagtaccatatattggacactgattcagagcatacacgggcttctggagaactttgcccctgccctgcaaagtattgtcacctagttggcattgtaattgtgacttcaaaaggccattccacacttctatcaatccagctgcttcaggatgatggggaacatggtaagaccagtgaatttcatggtcatgagcccactgccacacttttttagccataaagtgagtgccttggtcagaggcaatgctgtgtggaataccatgacggtggataaggcattctgtgagtccatgggtggtagtcttggcagaagcattacgtgcaggataagcaaacctatatccagagtaagtttctattccagtgccctttccatgatggaagaggtctaatataatcaacttgccaccaggtagctggctgattaccctgaggaatggtgccatatcaagggcacagtgttggtctctgctgctggcaaatttggcactcagcagtggccatagccaggtcagcctttgtgagtggaagtccatgttgctgagcccacgtgtaacctccatccttgccaccatggccgctttgtttatgggcccattggacaatgacaggggggtggctggggaaagaggctgaaccgtgtctgcagaacaggtcatcctatccacttgattatttaaatcctcttctgctgaggtcacccattggtgagcactcacatgagatacaaatatcttgtttttgaccactcagagaggtccatccacatacctcgtccccaaatttctttctcaccaattttccaatcatgcttcttccaagtccctgaccatccagccaaaccattggctacagcccattaatcagtatataattacacatctggccatttctccttccattcaaagtgcacaaccagttgcattgctcaaagttctgcccatagggaagattttcctttacccttcatcattcttcaggggtgtcctacaaagcggctttagtgctgcagctgtccacttttgggtggtgcctgcatattgtcagaaccatttgtgaaccaggccctagtcttctcttcctctgtcaactgatcatggggaactccccatgaggccatcagtgcatgctgggggagaaaagccagggtggctggagtggagacagtgagtatttgaaccacttccttatgtaacttacttgttccttcagggcctgcttgagcccaatcacatatagaccacttccgtttgatgatccagtgctgctgtgcgtgacccactttatggccagatgggtcagaaagcatccaattcatgataggcaattcaggttgcatggtgacttgatgatccatagttaaatgttcagtttcaaccaaagcccagtaacaggccaagagctgtctctcaaaaggagagtagttatttgcagaacatgccttgctctaaaattctagaggcctctgctgtaattcatgtatgggggcctgccaaagattccaaacagcatccctatctgtcactgacacctcaggcaccactggatctgctgggtcatatggcccaagtggcagagcagcttgcacagcagcctggacctgttgcagagccttctcctcttctggaccccactcaaaactggcagcctctcaggtcacttgataaatgggctggagtaacccacccagatgaggaatgtgctgcctccaagatccaaatagacctactaggtgttgtgcctctttcttggtcatgggaggggctaaacgcagcacttattcaccttagaaggaagatctcaacagaccccacaccactggacccctagaaattttactgaggtagaagtccttgaattttagtcatatttgtttcccatcctcaggcatgcaaatatctcaccaataagtccaatgtgtttactacttcttactcactagatcaaatcagcataatgttatcaatgtaatggaccattgtgatgttttacagaagcaaaaagcaatcaaggtctctctgaataagattattacagaaagccggagagttgatatacccctgaggtaggacaataaaagtatattgctggccttgccagctgaaggcaaatttcttctggggtttatggacaggaatgaagaaaaaggcatttactaagtcaatggctgcataccaggtaccaggatatgtgttaatttgctcaagcaatgaaaccatatctggtacagcagctgcaattggagtcaccacttggttaagcttatgataatccactgtcattctccaacatccatctttcttctgcacaggctaaatgggagcattgaatagggatgtggtgggaattacaacccctgcatctttcaagtcctgatggtggcactaatgtcagcaacccctccagggatgtgatattgtttttcatttactatttttctaggtataagcagttctaatggcttccacttggccttttccttcatagtaaccctcaccctaccagtcagggaacaaatgtgggggttctgccagctactaagtatgtctatgctagttatgtattctggctctggggaaatgaccacagggtgagtctggggactcattggacccactgtaagtcagacctgagctaaaacactgttaattacctgacctccttaagcccctactttaaccggaggaccacaatgacgttttgggtcccctggaatcaatgtcacctcagagccagtgtcccatagtcccccaaatgtctagttatttccctttccccaatgcacagttaccccggtagaaggccagaggtctccttggggaaggatgagagaaagattccttgcataaattgttggtaatgtagtggagtccttcctcaagggggaccagcctccccttcattcaagggattctaggtctgtaaactggcttgtctggaaattgaggagctatgattctgtttttataattgaaattagacttagaagttttctgcttgtataaattaagtacgaatgccgtaggctctctatcaatttaacttctaagaacaccatgattaattagccagtgccagagctctacatgagtcaaactgttctgattgccactttacctctgctgtccattacggtagctatgcctaccttgcttttgacagttgagtgctgccacttggcccatgccaccttgggatccaattattcccattgtatttaaatttcatagttgggtgactgtggttcccactgttagatctgacatactgagaagagcaattacagggctcttcaaagatgcaggttttgccctcacaaatctattttgcaaggcattggtcaagggtatatattctagacctaaatctccctaagcctttgcatcccttcctctacattaaatcaagggagatcaggcatttccagctcactcacaatgggccatatcaatctgattatctaatgtcaagagatccgggtcccatagtaaatccttggccactaaggacagctggtagagatgactcttatcaaggaaagaggaacatacctggccaaccccattgtttctatagcacatagggtatcaactttgaccaaattctgggagtagtttgcctcacttcttcctcttcttctatacctgatggcaaacaacttaacatttaactctaaccctaggctgttaaattttcatgctagccaaaatgcttatctgcctttaacagcagcttgaatacttccccctaccctttcaaagatttatctcaggaacagtgcagggggacaaggccaaatcctgttttgtttctaagtacaggaagcctgaactgtactattatttagataccaccacttctgaactaactgcaagcaggagagtcaactatatcatttcaatgtgtttttataacacagcggcagattttagaggtgaaacttggaagagattgatctttttctacaaggaggtagagaatatgatgagaaatttctctatttgcactgcaagatatctttagtgaatctcttctctattcctcagctacaaacattttaactttttctctacagcaggttcatcacagtaaagatagtaagccaagtcctcaccttttctctggaaaatataggaagaaacaaaatagaggtcagataaaccagaaattgcatttaggaaacatacaaattgaccttgtaatgagcatgctgtgtagtttttttcccactatgttttctttcttaaaatcaaatctaaataatacagccatcatgtctagttaatagttgtgccattggctgggtgcagtggctcacactggtaatcctagcactttgagagaccgaagtgtgcagatcgcctgaggtcaggagtttgagaccagcctggccaacatgttgaaaccccatctctactaaaaacacaaaaattagccaacagtggtggtgtacacctttaatcccagctacttgggaagccgagagaggagaattgcttgaatccaggaggcagaggttgcagcaagtcgagattgtgccagtgcagtgcagcctggacaacagagggagactccatctcaacaataacagcaataacaacaaaaacataattgtgcccttagggggactaaaacataaagttattgaggggaaaatgtcacatcacaagcttcccttgttttacaaggacttgaggttaagtaatttcttccttccttatggttgtaaaatattgacttcagaagttgtcaaattagcctggcatggtccttgttacaagtaaataggttccttctgtggaggcactagcaatcaactttcccaaggatgaggtgctgatatcccaaggcttgcctttctccctattgaatttatctatttgtgcacctgtacacttaggcagacaatgtaatacatctatttatcgctaccaccagcgtatctgtctaaagctataactgaaggcatgtgttctcataaaagaagagaggcacattagtctagtttgatgcagcagtcacaggctttatgtagtgacttatctggagataagagtcttgactgttgttagacaccaccgaaagtcattactttgtgactgcaaggaggatgacaactcaactgagtgaaacttccagcaggttgtgcattagaacttagaacaacaaaagtgagagaagtgggggtcctggatttctattgattacaaaataagctgtttatcatcataatataagctccttatgaccagtgactaggaatttatttaatattatgcacagaagttttttaaaaacagaacattgtatgtgataaatttttgccagcaaatagatgggtgcatgcatggatggatgaatggatgcacgaatgaatggatggatggatggatggatggatggatggatggatggatggatgaatggatggatgcacaaatggatgaacgaatgcatggatggatgaatggatgaatgaatggatggatggatggatggatggatggatggatggatggatgggttcatggatgcatgaatgaatggatagatgcatgaatgaatagatggatgcatggatggatggatgcacaaatggatgaatgaatgcatggatgggtggatgggtggatgaatggatggatggatggttggatggatggatggatggatggatggatgcatagatgcacaaatggatgaatgaatgaatgcatgaatggatggatggatgggtggatggatggatggatgcatggatgcacaaatggatgaatgaatgaatgcatgaatggatggatgagtggatggatggatgcatggatggatgaatgaatggatggatgagccagactacttactttcagagttttcacgaataatataggatgctaggttactaaagttattacaaatgtgtgatttttaaggaatctacaatcagaatgatgcctacttctctggctgcttcttgtaacctccacgccttgcccacagagttctagtcacaccatagttctttctgttcttcatgcctgtttagcaccagggccgttgcacaggctgttcctcaggcccaaaagcttttctttatgatctccacatatctctttctttcctgatattcaggattcacctcacgtgttctatcactaggagtgattcttttaaccactcagtctgaagtagtgaccagattgttctccatcatggttcaatttcaattctctcctcaacatttattgtgcctttatgtatttatttgatagttttattttttctttacatttgtggctttatttatctttcattctccaataacgtttgagcttcacgattatttcccagcttatttagcactatatcctctgcatacacatccagttatagactgaatgaatggaagggaggaaaaaatcaaacattctcccataggtttaattactaaaaattccctaaattatatgcacccataaaacatttaaaacagtgtaaatttatacaaattagatatatactttgaagtgatcaaatttcctactttaaaaaggtggttgtgttgacctgtttatctgtcagccttggaaatatatcaaaggttaaataaatataatcatgttatattcttaaatcttttcggaatgaagtgaggtataaacacatgtgtgcttttatatatataaacacacatgtatatatacatgcacatatttctataattcagggatttgttggttcagactaagaactcttagttcctagttctttgctctatgatgatttagaaacctggaattttttaaactgaaagggctaatgtcttttcgtgcagtggttttcactggaggcagtaagatcatctaccgttgcacttggcattttgtgacatgtgttagttattataataaatgggagcactaaaaggcatttggtggccaggggctaggtttgctatatatctcaatgcatggaaaagccttatacctgaagaaagctttcatatctcccacaactttcaaaaatctgttcacaatcacccgagccttatacataattctgctttacttttaaacacaaagtattttgcactcagacctgccaactaaactctagccccaggtactaagctttcaaataggaactgtggcttattacattttactccctttttcctgaaaattcattaaaattcagttacgaagtctgtctttaacaatatcaaatggagcctttaaacgatgaccacaatgtatagtcctttcaaggaggaatgtctttgcccatcacatatctttctgaatttctagaagtctgttaaataaaaaggaacaaatccagacttaggtaaggagatattttgttcggaaagacttttatagtgagaggaaaaggactattgcaatacagagaatactctgaccataagatctgcaaacatctcaaaggacaggcagaaagggctcctcttttacaggaaggagtaaacaaagctagaaggagctgtctgtgggagtgtgaagaccagatggtgtggtagaacaactgattggggaatgtttctcctaggtgtcagtggactcttgagaggggccttaaaggatgagctcttctatattctgatgcttggttaaagtcaagggagagtcaaactccaggtgtctgtggagtgggaaaaccctaacaaaattttggtccagacaagtcagcagatacttttcccagattgattaaattgtataaactcagtaaatcaaaggatgatttcattttccttccacaagatcacagtaaggtttgtttgccgtttggggaagtcgcattcctaatggtcgcagtgcttgtggtatatgagcagtcagtacaaccacttgtatcatctgcatttgtggttaccaaattcgtgataattctggaagaaccaatgcaaacaggtgacgactgtgttttatcttttagtgtactaaagcagttggagaatatttcatttttaattgacttccttttgtttctccgttatattaatttaaggccttatatcagttttccacttccctagattatgtgtagagctagacaacatggctgtaaatgtaatttcaggaaaataaaggtggcattatgaaatatttgttctcaaaaagggctgtaggtcctttaaaactgcaattcctattccactgccagattattatttatgtataatgactctgaaactaacagaagttgagaaatttgcccaaagccacagagaatattaatacaattacacacatacatactcttaaattgttaaaaaatgttgacatgacaagcatggggctaggaatgcagatgaataaaaatgcctttttctgtccagtaaaaaaataacttctacacagaaatgataaaaactcaattaagaagtgactggtttagcaagcaaaaagtcctagaaaatgttatttctgataagtacattaatacaaacttttcattgctggaaactttcttgctatatttaagacatgtgaaaaagcaaaaaacaaaaacgtctagaaatctatttcttaatctgcaaaatggggataaaaatatgtacctcatagcattgtgtgactcaaacaaggtaagtgatgtgatccatgatttccaaacattaatgttcttataaattacctggaaattttgttaaaatgtagaatctgatttttaagtttctgtgggaattagaattctgcattttgaacaaaatcttcagtagttaccaataatactggttagagataattttgaatgggaaagatggaaaccccttggcacattggaaggggccagttttggttggaggtccttggcttccactcttgtactagctctttttgaagaggcattggctgtttccccacagatctcacttgcttcttttatttttagatcactcccatttcactcatttataggttttaagaatgaggggagtgattagatgaagactgtttgagggactggtaattaatactcaaaaataaatttttgaatatgcttctttcttcttcctattaaaagcataatgttctggtactttgtccacgtttaaagcagcctttctggattaatatagctactaatagaaaggggagaaaagttgctatggttagaatacatgtgttcctctgaaattcctgtgttgaagcttaaccttcacagtgatggtattaagaggtggggcctttgagtggtaattaggtcatgttgtaattaggtcatgagggctctgccttattgtagagagaggagaaggactattgcaatacagtgaatactctgaccataacatctgcaagcatctcaaagggcaggcagaaagggctcctcttttataggaaggagtaaacaaagctagaaggagctggctgtgggagtctctctctctctctctctctctctctctctatctccagacagacagatagatagatagatagatagatagatagatagatagatagacagacagacagacagacagacagacagacggatagatagatatagagagagtctcacatctcactctgtcacccagcaggctgagatgcaatggtgcaatcgttgttcactgtaacctgaaattcgtgagctcaaatgatcctcccacctcagcctcctaagtagctattttttattttttttttttagggttggggtctccctgtgttacccaggctggtttcaatctcctggtctcaagtgattctccaaccttgcccttcaaaaatgctgggattacagtcatgaaccaccatcctgagtgtttaaatacgcttctaaaagaggcttcatagaactgcctgtcccttccatctcctctgccatgtttttacaagattcatcctcttttgcccatctgccttccaccatctgatgagatgcaaccaagtgccaccttggaagcagaaagtgagccttcatcaaatatggaaaatattggcatcttgatattagacttcccagggtctagaactggagacataattttctttgcttataaactaccctgtctaaagtattttgttacagcagcaggaatagaataagatataggtattattattatattcttctggagtgacattcttattactcatatataaatattcatatctacttatctaaaacaatcacatttcttattttacaaaatagttttacagttcctcaactgggatacaaaaagcccacttttttagtgagaaaaaatgataaaatgaaatacaaaacagttctactagcctcaatattctacagatgcttcttcaatggacctaagaatggtaaacagatttttttaaagacatccaaatctaagacaccttgtatttttcagttttaccaatagatgacactagtgatacacacgcacgcacgcacacacacacacacacacacacacacacgtatataataacattccaagaaaattcttcaagtctgcagtcttggggataaaagcccaaggtaaagaaaccggtaacaccgagttgttaacatactaacattgtttttatagagtttttttattattttcatagaatttgcaaaagcatcttcaaagacagtttttgtggcagatgactgagcatctaaattatttttatcaacacacaattataacactaatcctgaaataagaaaaaatcagagggacttcatgaaaggaatatgtgaatatatatttcatcttgtaaaaattggttgcttattccttcatctataaaaccatgtggtctgaatatattgtttctcaggccctggatggagtaccaagaatgcagcctagtaaggcaagacactgcctaaaaagatggtcaaattatctagaaaaattagtaatgtaatcacactgtccaaagtccccatgacatgggagtttcaagggttgtcatgccttccagatgtgagggaccatagtttgtaacctgcaaaacaatattattgtgagtggtgcttttctttaaatgacgtctctaaaagcgattcacattcttgataccactttggaattggagatatttcatttagagcccttgaaatctgagtactagtgtgcatattttattcctgccttttctcttgttactatatgcacctaaaccgagtatttttatcataggttttttggttgtttgcttgttgttttttttttttttttttttttttttggtagagattgggatttctccatgttgcctaagctggtctagaactcctggactcaagcaatccacccatcttggcttcacacagtgctgggattacaggtgtgaaccaccatgcccagccaatttttatcataattttaaattggcaactaaccagatgctttatgttacccccccatcatcccctacaaatgactccatgtcagacacagacattaatcggtttatggagttaaatttacaaaaaggaaataggaaaaagcgacaggtgcatggcattacgtgctgtgatgtgtattaaaagagagatctcacagattgaaaggagatgtaaataccagcaggacatatttttcaaaggacacattcagaagaatcccatataaggttgcctgtcaaaggaagccattccattttaactgaatatttaagaattttatagtgacataggtttcatttggttcatatgtgatatattttattagtaaaatatatagtgcatgattatcactacccagatatgaagcaaaagttgcataaatcattgtaatttttgatgaaacaaaagaatatttcgtaatgctaatcgttattttattttttcaaaaatttgtaaaagtgagaggctaatgggaagcctaaccattggcaatgaaataaattccattttgattttcttttttaataaatattgctgcacattcctttccaggatcaagttaaactccttgctaattctttcattgaacaaaataatcgtaaagaaaactcataacatattccgatttcagcatccgtgggtattagtagtcacatgatctacctttagagacagaaagttgaaatctgatttttttaaaaaaagtaagtgcagtggcttaagtgattctatgcttttagacagtattgtcttcaataattaatttgtatagataaatgtagcgtagcatctttacatattattaaaatattgttttgagattgtcatggcaatatacatgcacaaaatatgtagactggaacaacaacacaaggtactcagtaacatcattaaatgaaaaataaggtttttggttatgtacatcctggttctactctttttaaaaaaacttaaattaattcattaagaaatatttattacagagaaaatgatatatattcaaatatgtatttatatgtattcacatatataatacataagatatatataagctatgaaacacattaattaaaataaccatcactaccctacttaacaaaaaccatatattgcagtcttagataaagttgaaaaaaattattggtaaaagtttctaagtaaatctactaacataaataattaggccttttaatttttaattatcaaaaactatatttttctttattttatttaagggtaaagattctcacagcacacatgcacaaccatgatatatatcatctaagaacttatttctgtatatggttgggcagtaagcaattctatagatgtatacacctatataacctatattaaaatatggaacatttccaacttcataaaaagttccctagggttccatttcagtcaatatacaccaagatccaaacaaaactgatcaatattccaccaatgtagcttacttatgcctgttgagaactcaatataaataggattatacaatatagactcttgtgatattgtgatataataagtaagttatatttggtctctgctcttgcttcctgacacactgcttcgaaaacccttagagagtgtcttttgtatgccaatgagctgactgttggccagggttcctgagatagcttcaggatgggggctgttcaccagaaagacggaggcatgattagagagttgagactttcaggcctaccccgcaacctccgtgaaggagagagaggctgaagatcggttgagttcatcacctatggccagggatgtaatcaattatgtctacatgataaagtcttcataaatgtccaaaaagacaagagtgtggagagctttcaggttgctgaacatgcagaggctcctggggggtggtgcaccaggagagggtatggaatcttcagctcctttcctatacctcaccctatgtatctcttccatctggctgttcatttgtatcttttctaatacactttgtaaaaaatggataaatgtaagtgtttccctgagttctgtgagccatcctagcaaattcacagacaccaaggaaggagaaaattcactggacctgcgatctgtagacagtcagaagaatgggtgacagaccattacaatagtcccttgatgtcttccaagatgccttgtgcataccaaaatccacagatgataaagcccacaattggccctgcaaaattcccagaaacaaaacgtcagccccttgcatccctctaattctgtattttttgatcctcagttatttatccaagaatatggaacactcagattctgagggcagattgtacatgtgattggtgtctgaagagagggaatcttgtgggactaagcccttaacccatgggatctgactctgacttcataaagttacttcagttctgacatgatagtggtagaattgaaatgaattattggacacttagtgtccactagagagttagttgttagtggggagaaatccatacacattttggtgagcagaagtgaactattctgtgttgagctgtgagttgtgtgtattagagtcaaaaacagtttgatgtttcccatcttttccaatggttccttttctagctcagactctcctctgtgtccaacttcactcacattatataaagtctgtgaggttttttccttctgtatgtatagcaactgtttgttccttttcatagttgagtagtatgaatatgtaatttctggtgtggagctattatgaataaagctactgttgaacctctgtgtataagtctttaaatggacatgtgttttcatttgtcttgggtaaattcttaggtgtgaaatttctgaatcctataagtgatgcgtgtttaagaaactgccaaactgtttatcaaagaccttccaccattttatgaacccctcagcaatgtgtgagagctgcagttagtctgctccaggcagtcatcaactattaccagttgactccactcccacattctactgagtgtgaaatcatatcttattgtagttttaatttgaattttcttgatgattgctgatattgagtgtctttccatgtgtttgttttcatgtttatattagttacaaaaggccattaaataattcagatacaaataaatattttgtcagaaatgttacaaatatttctttttagtatgggggatgactttagaatttcttggtgtcctttgagattagaagactttcattctcttggaggccagttttttttttttttttttaatgtttcaagcttttgtgtgtactatctttgaaaactcataacaatattttcttatatttctgtctctggaatttttataattttaccttttatgcttatatctataattcatttcaaattacttttcacgcatgatgttagtaggggttgtagtgaattgaattgtggcctcaaaaagtcctatccccagtacctgtgaatgtgacattatttggaatagggtctttgtagatataattaaggatcctgtgattagatgatcttagatttagggtgggctctaaatccaatgactggggtcactataagaaaatagagatggtgatttgagacacggacacaggcgaaggtcatgtgaaggctgagacagaaattggaattatgccttttcaagccaaggaatgtcagggttcacaagcagataccagtagctgggaaagaagtatggcatggattctccttcagagcctccaaaagaacgaaatctaccaacaccttgatttcagattttaggcccctggaactgtgagaacataactttttgccattttagaccaccagtttgtggtaatctgttgcagctagcacgcggggcgggggtgggggtggggtgtcaaggtttttttattttcacagatggcataatacagttgttctagaacacatatcgaaaagattgccatttcattgttaattattttgatgcctttgtcaaaaatcaaagtgcaggtcattcctagacttgctgattctgttccattgatctattttttgcaccaatgctatgctgtactttacattttcctgtatgtcaattctctactgtcttgataacagtagctgtataacatcttttgagatcagataagatagatctttcaagtttgttcttccttttcagatatgattttgctattctcagtgttttgtatttctatatgaatttgggaattgaattgtcaatttctacatttttttgtagaaattggactaggattttgatttaaattggttcatgtttataggtcaattggtagaaaatagatattttaaaaacattgaatcttttgaatcatgaatatagtataaatgcccatgtttttgaggttctatttttgtaaaattttcaactgcgttttccagtttttctgtacagttattgcatagcttttgccaaactgatttatgattattttatattttatattatggtaagtggtattttaaaaatttatttttttcaattatgttagtgctagcatataaaaatacagttaatatttatatatttaccatgcatcctatgactcgccaagtttatttcttagttccagcaagaaatttttgtacctatgtcaagattttataatgtggaatatcacataatctcagactaaagagttttagcagttctttttttatctctattaatttatttgcctttttggcttattgcactgaatatgatctgtagtaccatatagtataaaattagtgagaacaaatattttttatctagttttctcatattaagaaaaaaagcactcagtcttcaatcatcatgtcatgtcagctgtaattctttgaaatatgtactttatcaggctgaagatgtttacttttcttcatagtttgctaggaattttcatcataaattggtgttgactttctaactgctttttctgcatctattaagataatcataaaatgtgtatcctttgtccctgagatttaatagattttattggttgattttttaaaaacatattgaaccaaatttgtattcctttaataagcaccccttcagtcaagacgcattttccctttgtattttattgaatttaatttcctaatatcgcattgaaaatgtttgtgttcatatgggatactgaatagtaatcatatttttttcttttattgatatgtcatactagtacatattttgatggtatgtgtggtagtacatgtaggcaatgtgtaataatcagcttttaatatcagggaacttccagcctcacagcatttgttggaaagagtttcctcttctgttttctaaaatagtttgtgtaagattggtataaattctttatttaatgtttaatggattcttcaatgaaagaacgagtctggtgtttttctcataagaagccattccttttcttttttgtacttactaagttactaaacttttttattttatctaacgtttccaatttttgggatatatttcctcatgattttattttatgttcatattgatatttgtaggttttatagaaatatgctcattttatttctgatattgtcaatttgtgttttctctctttttattactcctgtttggaataataagttatcaatattatagatcaatactattggtcttatatcaatattgatataaaattgattattgatcttttcaacaaactaacatttgccttattaattttttctatagtttatttttttgttttgctattgttatttttgtttatttctgtttgtttacttttgctaaaagtacttttcagcttctgtaggtaaatacttaaatcattaattttaaatatctttttctagtattgatactttaaaaatctatattttatatttaaactgtaccacttttggataatgtataattggatctgctttacttctatctagcctatcaatttctgtctattaattgggactgtttagtttatttacactgaatataatgattgatctcattggtttaagtggacgagcttactacttgttttccatttgaccctttggtgtcttcttctcttttgcatcttttttgctttcccttgggttattctttattttagcattctatttcacttccttattgacttcgcagctatatctctttatgtttttaattggctctctatggtaaacgatatgcagccttaacttgtcggaatctgttaccccttcactcttcacatgatctgagaagcctaaggaggtttggcccagcacagggatagcccagtcctaaaccagagtctcctaccgtgaacttaagaatccctgtccattttgctcagctctcttctctcctgggttctgtcctgcagattcaagccacttcagctgcctaaactctcgtgcctgccccatcaggtcagtggaacactccagctatgcttggattccagttctctcagatgtgatcataaaattatgctcaggtagcagtgggttttcagagtgctcaccttgtcaggttcccttctcagtcatcacagtttgtgctgcatgttgaccactgcctgaattcaactgcttcatgtattttgtcaagttacaaacttttatgtggtcaatgggctagtctggtaccagttattaagttatgaccagaagtagaagtcttattagaatgtactgttttgaaaaggaaaaataccgacatgtacagcaagagcaaacttggggttggagaaagattaccgtataattataaagatcaacaattgaaaggaatttgtgtggggaggcaccacaaaaagtaacatgatttataagcagacatgtttttgtgtctcatttttcatacgtatctgtaatgtaagatggagttaaaaatcacagtcttttgagttacacaaaaacggatttgaatcacttttgcctcatataagttagatgaatatttctctctcaaatatcaatttacccatctatgaagttgaaatatttatattacctatcacaaaccttgttttgatggtcattgaaagtaattaaagtaagttatgtaatgaatctgaatgtaatgaagttatggaatgaataaaattatgtaatgaatctcaataaatgtaagttattatctttatcatctgcagtagaattattattattactgccttatcattaaggcattcttaaatactttgttacaattagatggttaataatataaaagttagttttttacaaacttaaagtaaattcttactgaagaactaggtttatatgtgggggtgtgtgtgtgtgttaactcaaaatatgcaatacccacacactaaatatacacagtcctttgagtcaatacataaatttaggtacagcataggtccaactctactctatgttctttaacttgacatttaacttgacatatgctgagtatagctttgacccacaaacgtaacattatttagatgtattttaggataagaatgtaaatgtgagtcatcatttggttatgactttatttttagttaattcttaactaaaattttaacaagtttcagaaagacattgcagtctgagtttgacctacagatcaatccgataaagatcaaatttgagcaggactttttctttccccaatttgtctgtctctagaatggttatctatgtaatacaagagaattcttagctgcactcacccaataaaataaaaattctacattaccagcagataattaatttctgttttaagatttctgggtgaataattcattattatgttcagcaacccaaatagtgacaagttaaaactttactcagtaaggacaataaaggagatagtacccattcttgtctgtcacattggtctagttggaaatagaagagctgacatcagaggcctttatagtctcagatagtaggtattatacaaaattctgatcacttccatataagattgaaatggaaatagttggaaaacagctgttttatcttgtcagatcctttaatgggacttaaggttcacactagcagaacccaagaatatttgcaagaaattgctaagtaatgaaaatttatcctgcagttccaaccagaaatgaaagtatcatgtcagtgcaattcccatcagatggtctttagataaagaatctgggcttttaacttcatttaatgaaaaaaaccttggtaatcagtcttgtagtgtaatggaacttttatctcactgtgtaagtaaattatggatggagttatacacccaggaggtgacctacatagtatactcaaaaggcaaaattaagaatggtattcgaccttgaaccaaatttcacacctgtactgaaaaattaggggtaagcttggtaaagtgctgaatgcaaacatctcccagacaagccaaagtattttattccccaaacattcctcctggatgtggatccttactaaatctcaactttaggagttcttctcttggttgggcacagtggctcaggcctgtaatcccaacactttgggagaccaaggcaggaggatcgcttgagcccaggaattcaagatgagcctgcacaatgtgacgaaaccccatctctactaaaaaaaaaaaaaatacaaaaagttagctgagcatggtggtgcttacctgtggtcccagctacactcagtcccaggctgagttgggaggatcacctgagccataggaggcagaggctgcagtgagccaagatgaccctactactgcactccagcctgggcatcagagcaaaaccctgccaaaaaaaaaaaaaaaaaaaaaaaaagacaatttttctctctttgttttctttgttttttagagaataaatctgaaactgcttgaaatgtgttaatctgcacctttggttgagaccatgaccttcggcattagaaagacaatagttcaaacatcagcttagatattactatatttgtgactctggatgatttacatacaacttttgaacctcaattatcttatatgcaaaatgggactagaacttgcctggcagagttaatttggtaaatcagtaaaataatttaaaagaaatgatattactatgcttaacacattttaaatactcaaaagtagctataattattatggatgttatgtatttcaaatgtgtaaagttttaagcaaggtactaaacctatggcccccttttcctatagttaaagtgggggttatttaaaggaaaagaaatcattatattgaagatacctgcactggtatgtctgtcacagcattattcacaatagcaaagatatagaatcaacttaagtgtccatcaacatgattggataaagaaaatgtgatatatatctatatatataggcaatgtataatatagacatatatctcatatatatataccttcaaatatatacatctacatatgccatcaaatatatacatatatataccatcaaatatatacatatatatatatataccatcaaatatatacatatatatatatagacacacacaccatggacataaaaatgaatgaaatcatatcttctgcagcaacatggatggaactggaggccattatcttaagtaaaataacttagaaacaaagagttaaatactgcatgttcttacttgtaagtgggagctaaatactgtgtacacatggatatagagagtagaataatagacactggagactcaggaaagtgggaggaggggagggagtgaggaatgagacattacctatttgatacaatgtactctattcaggtaacggttacattaacagcccagatttcaccagtaggcaatgtactcatgtaacaaaactgtacttgcatccattaaatctataaaaataaataagtcataaagtgaggatattataactatattataaagttgttgtaaaaattaaacaagttattgcatgccacgtgagggaaacagtgcttgccattttgtaagtgttccataaatgttagcttttatttcaagtgagaatatcagatagtgtttaagaagaacaccagctggctgtggaaccttcctgccaggaatttaatactagctttctcagttacttaacctctctgtgcttcagtttcctcatctgtaaaatttgtgtttcaataatagcatttcccaaacaaactacttgggaggattaagtgggctaatacatataataaactcagaatagcacctggcacatgtaaatgcatgataaatggttttgtgcttttgtatgtgagtatatgctattttttccaaaaaacaaaatagagaaaattataaagactcatataacaagcatccatatgctcagtactaaaaagtaacaagtgctaacatgttgtatcattctaacaatataaaaatatttcaatagcctttttattctgaagtgaaatattgagagttttttcctttttttctgtaacgctgccacactgaattttaaaatgcaaagtactagatattagtaaagaccatgcgtcctcgaaatcagatttcttaagtttgaattagtaaagaccatgtgtccttgaaatcagatttcttaagtttgaattctagttccactacttagtacctatgaaatcctagctgtttcctaaacttcttttatcatgctttctcaccggtaaagtgctggtgatacgttctttgcaggtttgttacaaatgaaaataaaagtaggaaaaattctcagcacagagctttgccatgtagtaagtgctcatttcactggaaaataaattcctgaaatattttcataaagtcataggagtaaaatgggatttgaaaagccagctaatctactccctttttaatgcaatttttacatctttaaatttatgaagatctcactggtatatttaatctccttgaatagtgattttttttggactattggttttaacattttcataggatgtaaagttattttaattagttgcgatcagaattaaaagatactctatttcaatttaagctctacaagggcagggttttgcttatttcgttatgtatatatgtatacgcacacacacacacacacacacacacacacacacacacacacacaatctcaagtgccacatggtagatgctcaaatattttctgagtgttaaatgaataaatgaataagaataggattgattcaaatggttatttttaactacataaatttcaaatatttgtttgaataaatatataaatgttgtatttccttctgacctgaaccccatcatatagtctatatgatttacgcatatagactataatagctaacatttatttagcatttactacatgctaagtactatcctcagcactttgccagtattagctcatttactcctcatcccagtcctgtgaggaggccattattagcctattttaaaaatggaagctgagatacaaagaactaagtaattctctcaggactaaatagccaataaatgtgaaagcatttcacaaattcagctgcaaaccttggcagtaaagcatttgcttctggctagagtccatgtcagcccctgtttgtatttaacagacaaagaagaagatactttaacaatgaatcattcttgtgagaaaaaaaaaaaaatggtggtggtagattcagttctaaaatctcaccagatgacacaatcttctacctcgtgaaatactgcagaacttaaaaagagaaaagaaaagaagacctctttcctcctacagggtaagaggattggaaaatcacttgcacttttctctttatcacttctgttgacttggaatgcaaactttcaaaaagtaacatgtgtggtgtagtgtgatttttaactaaggttggatttcagtttcactaaagagccagaaatagatagaacagaccaactaagccctgctttgttttcctaaaaatctttccttaaatataaaactgtccctggacctgctaccatctttctatgctacaccagagttcatttcaccttactctgggccaccttttaaaatgtctattaacggtcttgttttattgacacatctctgctgtctacctcgctggttcaagaagttctcaagaatggattgttttctcaatcagttttatcctagtgcttagcacagcccagaacttcttgagcattccacaaatattagtttaaccagtgaaagaaggatgacaatggtttaagaaaaagggatactgtctatactcccaacaggcacactgtactgtgggctgacaatcagaggaaaatgtgttcttctttagctataggtttaagctcttaaatgaataacaaatcaagaccttcacccacactaaagaaggcaatttcattattattattaagatgcttaacacattgttgattgttgacacttgattgaggtattctttacttgagatggccattgaagcctctaaggttgaaaactgctaaactgtgaagggaaacacaaaagataaaggtctgcattttctttgatctagtcagggtgtctgattgcaatttactctctttaaaaattttattggattgaaccttaactgagaaaagagcgataggagagagactaatattttagacattttcatattaatttagagaagtaaggcaacaatagggctgcacccacagacctttattcagttttgaatctaaattacttggggataccaatccttcttcattgtgcagctacatgcacccacacaacatatacagaaatacatattcccccctttctctctctttattcccaattgtatgttcctttaatatgctgtacttagatttttattcatatgttgtttcttctttgccagaaaagaatgcagagcctcccaagggtaagaaatactttgtttgcgtatctgtcatatacattctcagcactttcacccacttgggtttcctgtcataagcttttctttagattgagcaactaaagctcagataaatcagaagaattgcctcaaagatgcacagatcatatgttttattgttggaccccatacgagggactatcatagggtttagtgctggaccccatacaagggactatcatagggtttgttatctgtgtgaaatgagagtacatatctgtgtgaatttgatcgggttacatgcatagaatcaagttgtgtttacctatatgcctattaaacccattccagtgtaggtttcaattgagtattgagtagtgaaatctaaagaagatgcatgtgttattttctggtggaataattttattttccctttgtagattggcaaaaaaaaatgatgagaacagcttaaattttgttttggggaaaatcttttaacaaaaagttgttgtcatgaattttgttgctttatgtatctatatatctatatctatatctatatctattacttcttcaaggtcctttagggactcaaccatttttcaataacagatttttagcagtaaagttgcatatattccctatatcatcccttccatgaaaggaagtggatcctaaacaacttgggttgtaggaatgataaatccctaatgtttatgtgactcagcaggtaggggataaaggcttaatttttgaaggtatattaaggtaagtaattagggaaccattatgtgctagaacagtatatctccaaagacaatctacttctacttagctttactgacctgcccagtaaattccacagaagctgatggcgtaatccaaatccagcctattccaagaaacacatttagatataattttagttagagtcattgttgagtttgaaagagatgaacacatttcccttcatcttgaaatgttcccttttggaaaatctaattctccccaagaaaatgattggatacctaaatcatctttgaaaagtaaaatctttccctagatcttatctcatcttttaaagctcatgtgtttgtctctgacaatgctataaatgcattttcaagagaggaatttgtcctactctttaaattacttttatgaatagtcaaagtgattttcctttagtgttcaaacttcctgcagatgattagtccacacttccagaaaccaaaatatataaagacttcttcctaaattagtcatataactttatattgggcaataagtgaatactgtgcaattttgctttgtcagtaatctgacaaatactgaaaaatactgatgtatatcaagattcaacttctgagtgcccagtggctttctaaactgatcagttaaaaagttttgtcagacgcctgtagtcccagccactctggaggctgaggcaggagaagggagtgaacccgggaggcggagcttgcaatgagctgagatggcgccactgcactccagcctgggccacagagggagactccgtctcaaaaataaaaaaattaaaaaaaatttttaaaaaagttttgtcatccaatgacaacaagtttaaaaatattttaagagaagtatgaataagtaaatactgtatcagattgattataaattatagaaaagttaaaataggtcagatttttcattcttcgttttcatagtttgagattcttagattattaaaatagaaaggaactggttttctaaaggaactggattcaaagtcacttctatcttatgaacccattgtatacatgacatctgatgaagaagaccaatatgaaaagcaggggagagtctctggttgaatcagaaagctcctggccaccacaaaacttgtaacttgctccttgtcctggtggctcaagaagtttgtgaggtatagtttgaaaactactgatctagtcaaacagtactttatagagggataaaaaaaaaattctggagatgtggcatgaactgaattatttacgatcacacatagaagtgaaggcaaaatttaaaatggaaatcagcacacctttaaaacagccttctccatggaaacatccctgagaaattttcacccttactgatcattttgtcttcccatcttctcagcaaacacatcatttattggctatgtccacagtaacaatgtaatttgtgaaatgtttcaggtcagtgaagtaatctgggagaattgaaaatgctttgagggtagaactacatagcacagctttttgagtcccatagagtgcttttggtctatataaacaaacaatggataaaaggaagataagaccaacaatacagtattatacagtattgctttggaggcaatatatagcacagaacacttttatacagaacgtgacaagtgtttcaaaggaaaggatttcatgcaaaagtaaacttgataaagtctgcactaaacaaagttaaacagtaatgattgcctcctctgagttttgaatatgctaatgtatattaagaatctgcaataatgggaatttttcgaattttccatagagccttaaaaatatgatagatattgcatgcctcaagttcatggtctgcagaatatatttagtaaaatttaagaaaggaacaagactagaagtcagaagtttgatgttttgaactcaaaccctgtgccacaaaaactttggaaagcaacttctctgatcatcagtctcttcatccataaaatagcattgcctatctgagagttaaatatcaaagaagattaatataaaaggctttgcaaaaagttaagctccactgaaacataaagcatgtttattgtgttgtaagtttacaaatataactttactgattgacttgaatagaggcacaaacagcatcccttcaacaacattttcagaataaaacaatgatatttctagacaatagtgtctcaaataaaaaaccaaagttttattcaaataacttgcaattatgatagatatttttcaattttatttagtagccaggaatttgaatgttaattactttatcgtgaacttatttcttccatgaagaagctaattgaaaaattaccaaattctgtatttttgtaaacataacaaaaagatacattgagtaaatattttaaatctactcaagttacttgaagatttttctttatgagaggttacaaaaattaaacaaattcacatttctaacaaagaacaacatattctctctacaaatatatacattgtataatgtaatactaagtctaaaaagatttgcaaggcatggtggctcacacctgtaatcccagcactttgggagggcaaggtaggaggattgcttgaggccaggagttcaagaccagcctgggaaacacaacgagaccctgtatctgccaaaaaaaaaaaaaaaattgaccagccataatggcaatggcctggggttccagctactcaggaggctgaggtgggaggattgcttgaaccccagagtttgaggctgcagtgagctatgatcacgccactgcactccagcgtggaaaaaacagtaagaccctgtctcaaaaaaaaaaaaaaaaaaaaaaaaaaaaccctaggaagataaatttaagctactggttatttttaaaataattagtcacaatatttttctaaggaaataaagctcttttgaaacaactaatattctgatttactctaatttgccttgcccatgtcatcaaaacacttttgttatagaaggactacaaaaggctctcataactaatagtcttattagaaatgttttaatgcatagaagtagtcatttaaaggaaaatgaagacttttatgccaaaagaatgttgaattgatataaatggaaaaagtagaacaaggtttccctgtatttacatttggataaaatcaaagaagaatataagttccatgagggcatgcattctatctacttagtttactactgaatctcagagcccagaaaaatatttgaaatatgcaaggtgctttacacaaatacttgttcataagatccaggattgacagtgccctggtgcctgacggtggcaaacaaatatcctttctggaaaaagataacattgtccaagttttcaaattatttctacaaaccctatttcaatatttcctacacataataaaatacatccaggcagataaataaattgcaacacaagcgacaggagacacagaagcacaggtactacagataactggaaataaaaaaataacagataaatttgcaaatttgtaatgaactctcaactcagaattatatagtcaattaaaatattgttcaataaccaggttaaataaataaaatgtaatatagcaggtctaaaaaataaccaaataaaatcctataatagataaaataatctaaaccatttaatagatgttatagtggaaaagctagatttactgaaacagtatttggttaaaacaagtaatatgctgagagatatgttagaagaaactatccagaattaagacagtcaaaaggacacaatatagaaatctgagtagaaaacaataagagaggatgagaaggtctaatagaagagtcatgaatggaaagaataagaagaattaggcaaagcaatattcaataaatgttatgatctgaatgtgtccctccaaaattcatgttacaacctaagacccaatgtggtaatattaagaggtggggtcctttggaaagtgattaagtcatggtggctctgctctcgtaaacggtattagtgccctggtcaaagggcttgaggatacagcgtctgtcccttccaccatgtgaggatgggatgctggggtaagtcaccatctatggagtagagagtgagatcttaccagataatgaatctgctggcgcttagttctcggtcttcccagtctccagaactgtgagaaataaatttctattatttataaattacctggtctagggtattttgttacagcagcatggacagactaagacaatgaggttgatccttgcccaaaagaagtagaatgcataaatccacaggatcaataggcctaacaaatatggagcagtataaatggaagttagcacctagtcatattgtagcaaaatgtcagaaaaacaaatagaaacgtaaaattataaatgcactaagaaaaaaaaaagaaaataacaggatgccttcaaaggagccccaattagaatggcaataaacttctttaaaataataataaaaaacagaaaacaggcccgacacgatggctcacacctgtaatcccatcattttgggaggccaaggtgggcaggccacttgaggtcaggagttcaagaccatcctggcctatgcagtgaagccctgtctttaccaaacatatacaacattagccaggtgtgatggcatacctttgtaattccagctactcaggaggctgagagaggagaatcacttgaaccctggaggcactggttacagtgagctgagattgtgccactgcattccagcctgggtgacaaaaaaaccaaagcaacaacaaccaaaaaaacagaaaacactggaataatatcaatgcactgcaaaaaaacagaattagataatattcaatgaaaatattattcagtaatattgtttaataattttattatttaataataataattgtttaataatcaacgtgaaataaagacatctttcaaaatcaaaaattgagagaatttaccagcaaaaccccctgagtcaggttacattttccaattattgttttttaaaagtgtgactggcactgcacctgctcagaaataggatctatgttgtctcccctggaatctgaatgggctctgtgactcctcttataaataagtatggaagaggtaatactttgagacttctacaataaggtcacaaagattattctcttctctctgtctctgtctctctttcttgctttcttgaattttgcctttggaactcatgcatgctgtgaggaactccaacccaggccacatgtgggagagcacacagagaaaataacaggaaaagaaactgaagttccccatcaatagacagcatcaattccagacaagtaagaaaacaagacttcaaagattccagtccacagccttttaactcttccaaccaaggctccaaacctgtggagtaaagattaattatccccctataccctatctacatttccaacacacataaactatgagagacaatataaacaacttagtgttgagacttgtaatgtaatcacagtacctgaaactaattttggtaccaagagtggggtcctatgtaacaaagactttaaaaagccacaatgacaatgaatgggacagatggaagttgaaagggctttgaacaggctgagagtggaagcctgatggagacgatcagtgagagattatttaaaaaaataataaaggaggaaaatttgacacttgaagaaagggaatccttgttaacatactggcaaaaagtttaccgacactacactcacagtaaagtagtaagtagaaaatgtacttagtgaaatggataatttatttaaggagatttctgggtagagtgtagaaatgcttcctggcttctttttgctgcttataataaaatgctagacaagagaaataaacaggaaggcctgttaagtagagaggatccaagacttgcattcaaaaataaaaccgtctctctttccaacatccaagattctcaaaaaagaaagtatttcagagcaaagcaatattctttataaagactgcaagtatatgaaatggtgcctatgagaattgtagagtgaaacataagttcctttatggatcttaaagacatgctatattttttagaatttcatttaaaaaataaatctcaaattcaaagttaataaaacataagggttgacttttactgttagaataatatttttccaatgcccccaaattggattgaccaataattttctattcatgcaatatagcatttagcttcttgcaatatgctggggtcttcattgaccacttaataaccaggaagccaaattaataatctacagcataaaatgaatataatttctcaaatcaagagtactgtatttcattaaatccggccattgatagatatatcttttatataaaactaaaaaaactgacaaataaactatgacacaatactcccttattttataaaatcttattactaaaatttgtatttatactcattacattcaattatttaaggttttttaggtttttttcttataaataatttccgtgtggtatgtaaaaagataaatacttttgaaatggttaaagtacttctaaaacatcttaaaattaacttctaattatcttgattccctttatatctcagagctgttgatgtcattgttttcccacaccatagtttcttttgtgccatccaagacattattggtgcagcatttctaaaagattcctccactgttgtctgtaggattttcttctaagctctgacatctcatccattctgcaaattttactgctttcctgattttaccagatgataacaatagaaggttttcaggaaatatctaaaacacatagttctcaagtgattcttaggcgatttagtattttaaatgtcaaaaggtcacaggtatccagtgatgccacaaataataatgacaaaatttatatgtgtgcaagccactacttcatggatgccttctggccaaaaataattttaagatgttctgattgtgagctatctctagattaagatgttaaattatgacaaaatatgcatgctagaatcaataaaggatgatattttgggtaaaactatatgtcacttaatagcatgtgttgtcctaggcctagagtactttatttttatttttttatttttattttattttattttattacattatattttatttttttttgagacggagtctcgccctgtcgcccaggctggagtgcagtggcgcgatctcggctccctgcgagctccgcctcccgggttcacatcattctcccgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtctagagtactttaataagctcacttagattttttgtggatccaagagtgacatccagtaggatataaatgaattagattttccctttcccaaaggcaacctgaaagttatattagagaccctataaagtgaagaattggaccctgcctacctacagtggtttaatttaatcagaatcacaagcccaagctagttggttatttatttctgctgcctaagctctagataatataaatgaaattttatatggtgccagtgctcctctgatcaacatagctttgagtagcaatctgtttggtgtgagaaaattagtaaaattttgataaatatcagggctctgcaagttgaatctgatggtatcaagcaagtctaataataggatggggtattaccattcataggttttcaagactttcataagctcatttgtatttccacagttccaaatttcctggagaataaacacaagagttacaacttgatgacagatccctatgcattccaaatggccacaaacaagtactctattcatggaaattttgctaaccctggatatttacactggttttaaaccaagttcagtgttccaaataacaagtgctccagaattatgagagtcaaacattctgtttaaaaaatttgtttagctagtatttgggcataaaagtactttttttgctaagagatatagaatgtatttgtactgatagctcactatttatgaaatgtatcatttatatctgctatctgctatttaggcccatctatatgtatatgattatttgcaatctgcaaatagttataattaaatgtagccaagcaaaagcatgatacctgcaaatttctctccaaactgagtataattgctgctgatcaactagttatcaaatgtcttttttctgcttgctttatatcagtaattttaatatgaacgtattgatatttaaagcatcatcagagtagtatgtttctttctgttaaactttgctatgtgttttagtgtttggatagaatcagtgagtgaaattttgcaggcgtgtgtttaacatgagaggaggcaagataaagtatactgctttgaccaggtctgcaagtaatgtattaatagtatttacattcctgacctcaaaaatcagttcatgtaaatttctatcttgttcaacatattggcaaaggcaagactgccagaaagacaatttaaaatgccaatgtggtacaaagtaagagggatgtccaggagagtttggagtgagtgaggctttcaaatctgggcccgtggcggaaaatgggggaaaaaagtgcatgttctctggctttgttaccaaagtaggagggtagcattcagatgttgctctgtccaatagcagggtacagtggtaaacgctctgagcttaagatttagaggactcagagagagaggttaagaggctggcccaaggtaactaacataaaagaagcaggatttgcagtttattcttatgttttgttttgttttttactctataaaaacaaccactattataggtaatcttgtgtatcagaaatatatatatatatatatatatatataattaaatctccatagatagctcttctatggtcttgaattcacttgaatgtgcatgacatcatccataaaacttagtggtttaaactaataagcatttgtgattgctttgacatctatgtgtcagctgagtggttctgctgatctgagccaggtttggcccatcttggctgggcttcctcatgcatctgtgctcagctggcaggtgaacagggcagtgggtgtccctttatggacctcacccatgtctggcacttggctggcagtcacctggcacaacagtacacaataggccctgtgtctttcattgtccagcagagtatactgagctcgtttttatgtttatggcaagtattgagagtgagaggcaatgtgcaggcccttggaactggcatctttcacgtccatcacaatcttttagacaaagcaattcatgcaaccaatcccgattcagggggtagaaaaaacatactctcatcatgatgggaagagctataaagtcacattgcaaatggcttgaatacaaaaaggacatatttttaattattctatcaaagcttgaataagaatgctttagaaatctcagataaaatatttcaaaagaggtcacagtttagctgaaagtaagagttaaacaaatgttataaatgcaacaattaaaaaaggtgaatgttttggctcatgtggagataaaggagtagagtactaatagtgtaaataattgaagtttcatgaaagcaattttatgtagaagtacttactttaatttatatgacgtgttaatggttgaaaaagtgagatgaagaaattacacttatttagtgaactgattaattctaaaatattattgtaacatagtttatcttctgcttgcaaaatttctatatttggctactgagcctaaagtattccaatgtagattcatgtgaaaggttctacatatcagacaaacccaattaagaatgtgatagggatatagcatcacagagcagtttattacaaggttttttaaaagaaagtaattgttaatgtaactatttgttttatttttcttctaatatccaagtacataagaaaataacaaaaaagactgattgcatcaatacaaaaataaaaacagatggtcatgaacttttacttacaattattcaataaccttagaaaaatataaagatcattctcctgctttgaaagaatatgaaaggtcatctggttgatctttctgactttagatggaatattcttctcttaacacacagttctatatttagcaacaacatttttagaccagtgtacacaaaacaacaagagattagtcatttcaaaaaatgaggttaaaaaaaccttgattttatactgcaattagtatgtccctgcccccaccttgaacttattctgtacctccattctgcatctccattctttcgagtgcattgtagcctctgattatgttacccagggacaagacacttaacctcactggaatcgttttctactttgatgagcaggagacttatatactgttaaagttggatgctgtattacatgtgattacactaaaaaccagaacactgtaaatgttaagtgtggattttgcagacacattggtctttaaatcctttttctgtactttctagttaaatctcattggtcaatatttgagctttattagacttgatgtctacatatgaggcaagcagataatcacattaactcccttagttcccatgacaagtaactaagaaaatgcattaaatgagtcccttgcacatttccaatgtgtggcaagtgcttccatggtagtcataaaatgaataaaaaaatggttagacacatcagtttttcctaacttatttgatatagatgataagctaacgattattaacaaaagaagataaaagactgcggtaccaagctctgagctgaatagagcatcggtcactggattactccaatcaccttcaggttgcgtaagcttaggaccacaacagatgcacattggactcgatattattcaatcaccacaaacagaaacacccacaatctctttggaagaaaatttttgattaattcatttagtgttttatttaatattataattacttaattgttaatgactttcctgctctacctaaaaagtttccatttaaaggttttctttctcatttattaagaatattctaaaatctcttttttttcttatctctcaattttctccaaacaacaaaattgtccagtatatccatttttccatagctatctttagctattttaactctgaacacatcagttgaactgtggaataatttacatttgttcaacaataaacaaacatatagaaagctgatagatcaatgtttccctaggcttacagtgcaattatttaatctctacatggtataaagtcacccatatttatttttctcctgttcatatatttttatgtccaggacagtaatttccttacaggagagttcctaatgtttttgtttgtttgcttttatcaaagcaaaaataaaacatggagccctaaattgttttcaggagtcaacaggctttgttggggcgagtatgtatgcataccagaggaagtaatgaaatcatttactctattcactttcctcacaagaaacctgccaagaaaacgcgagtaaagacacagatcgatttttaaacctggaaaggacctaagaacttctctaggtcaatctttttattacatcattgaagaaactgaggcatagagtaagccactgtgcaaggacgcaaaactatggaaaaatctggataggaatataggcttttcttcttcctaattcagcatgctgttctctacatcatggtaagaggacggaagggagatctatagaaaactttggtccctatgtggttctgcaaccaagcatctggtgatagacctggggctgctatgggcaaaagccatccgtggaaaaaatgatagacacagagtggatgagagtgagaatacctggagcttgccaggcacctctgtagttgctcaaggactccatctgactatgacaacctacagaatgtaatggatgtaccacttcactcactctttccaaatcgcatgaaagttcatcttttgaccaaatctaacctgtcaccgtagagtgaataggattctgggaaatagagtaaagtttagctattctctcccagtaaaaccaccccagctggtaacctctgatccattctaaatgtaaaattcttcaggcatcactctgctaaatttattattttagaacagcaaagttctaaggtgaatagagtgaaatacaactttttgaaacctttttaaatttctacattgtaatattattgtgagccttgatgaacctcagtttctttcttcaatatctgtcatcaaccaaacctttaaaaaaacatgtaatactccttcctgtcaaaatgttcataaaacagctatttggatctctctttctctctctctctgtctctctctctccttgtgtgtctctctctctttctctcttgttccatctctccctctcttcatctctttccattactctctccatagctagctagctagttagctagttaggatagatagatgatagatagatagatagatagatagatagatagatagatagatagatagatagatagatagataattgagagaaagatagatggagaaatagttttaaacagcttcattacataaaagaatattaaagttctgaaactagatttttttttttttgtaaatttcaaaagaatgtagacttctctttttctttagtcaaatttttggtgctttcctggaagctaaaacagcactggtgctgaaagggtggccattgcgatcatactgtcttccccatacattttctcaagtgtgttgaaccttcccacagatgaaatgaactcttaaagggcaagcactgtttgtagtgctaccaagaggaaaggttccttctataaaacagtaccatttatcagacccactcaacactaagataaaggatagggatatggaagcaattgtcctggtcatctgaggaaataaccaatggatactttaggctaaagcatgtttggcctgaactacccaataatgacctcctagctccatgtggatatgtttgaatgtccacttaagtttatgtctctcttcactttttcctctgtttgtccaaatacaatatcaagatcatccccaggtgatttttttattatactctgcttgggtctttcagggagtacactcctaggtagaaccaagttgcctctgtccgggcaacggaagcctctgcttccaattatttctgccctgcaggcacttcttataaaggagctttctttgccaagttctagttattatttcctgaggcctttttttccctttccaagatacctcttgagagcaaacttctgatagaactgcaactttgtgacactagatagtacaagaatcattattttggctttttcactttctgactttttacacacctataattacatgctttgcagtctttccattcagataaaagcagtattctttaagacttttttttcctttcctttatttctgtggttatgattggaaagagaggcttccaggaacctccttgaaagtaccaacatatttcattcatttttaaagttctctttaatttattttttttctttcaactagttataatctgaatattattataaccataatatggtggcaaaactgtcaccctctttgcacgttcacagctgcacttaaagagacacttatgataccatggatagaatcacacgttgttcttactcgtgtgtctaaacaaagttagaaatattgctgaaaatcgtcaaagggacgtaggttctggatatgccaacattttgcatgattctgaaaatactttatagttgtgtctttcaggcgaatcaatcagaactttagtcgtaatcacaacataatcagcgaatccagtatttccctttgggtcatatagaaggaacatgtatctgatcagtataccaataaaaatcggattagttctgagattctccttatgattgagaatctacttcatctcaaaactgctttacaggtctgacctgctacagttcaggttaatagcacacatgtgtgacttaaaattacttaattgaagctacagatgtgtttaatttagattccatagtaacgtgtgtgtgcatgtgttggcatgcacacatttgtgcaatcaaaaagaccatctaattacaaaataaagtaaaaattgaggattttaattatgcataaatatattacagatagttgtacggcttcaagtcaattgaaaagaccattgggacgttaataattaaagtgtggatttagaagctttattcactgcttatgctacttaaatataattttcttttaactttaaataaagggaaaattgattctgattaaacaacaaaatggaaccattgatgttaactaatgccatctattgcaagccagatttttctagcgtaatctttttttttggaagacaatatgagatggagatcacagggaaaacttgacgaagcttgcaagataatattccaattagaaatacagaaacatcttgtttgaaaaaacattagcacacagaagccttcatattcttcaaacacacttatatacctttactcaattcagaaaaataaaactgtaagcttgagcaatatgtatagacatcacccttgtgttacatttttaaccttgcaaattctatttgcgttggaattcagttttccatttgtaaattggaatcactgagtcagttagcttacttgctatagatatccaaggataccaagctacaatatacatctgaagacttactaaaacacaagcaaccttagtgagcaggatatcagtgggatataatatagtgggttttggaaccacattcaccagcattcagagcctgtctctgttatgatttagctaagtcaccaattctgagtctcagtgcccatgtctataaaataaagataaccatatttaaggttttgtaacaattcagcgaggtcacctaggttacagactttttactgaaactggcatatagaagttaatgttatggttcatactatcatatatttcaaccttctgttaccaatgaggtaatatgtgacttatctcgaaccacgctattctagcatgtttgggaaagaaaacgggttttcttattctcttttcctgcagtgactaaaagaaaaaagtattgtaatttttgagaaacatctctgtgaaaaatatgtgatctagaagatgtctctgggtacatggatcaatgagccatgaaaaaaatgggaaaataaaattgtcaattttttgataattcaatctgtttgggtaggacctttcctgctaatagcttcccagtgggtaattctttatcggctttttgtcttatagttaaaatggcacaagtggtcccagtggctgttggcagaataatctgacattttatgttattggtttcaaattcccaccaaaaacacctccccatgaccagaagatttagtatagtccatagacagccaatttccaaatttttggctcaacgtagaagggttttgtcccattaaaaaatatcccccatctattccttgattgataggattcaactgctccacttattttgccatttgaccagacttaaatctaatagatacggatcataactaacagccagcctgccaacaaatgattcaagaatgctgtatggataatttttttctttagtaaaatcaaaatcaactaagccacctgctgaatgatattgctggaagcattataaacaccatgaccaagaaattcaactgcaacctcttctatgacaatcactaacaatgttcctcatagcttgaagctgaactgaacagaagcagaatgtataaaacaggcatgttttagtcattgatacctagatgggaggatctcactttcttgttctataaatacagcaatgctacttggctgtaggtaaataataaagtaaacaaaattatgttcttcatacccagagccttgagttcaagtgctggctatgctcctcattagccagttgtgggatcttaagtatgggaccacagtatgttgggattgcaaaatgagaaaagtcagaataaattacttttaagtttcttttattctaagttttaaagattgtccttttctacccccagtgcaggaacacagaagtctcaaatttccacttacaacattataataaacttacttattcctttattttctttgtttaatttggttattcaaaaaacttgcattggatatctgttatatgtcaggcacagggcaaaattctgaggatgaaacaacagtccacattattaggaaacaaatcatagcaatgagtcaagctgtgatcctctgtgatatttcttgcttcattcaggtcactgctttcacttatctaaagtggcaattatttggctacgcaattcatgctattgcaggttgcaggttgcccttggttccttatgaaatacaattcttgacagtagttatggcgaggagttggttctttttattatttcaaaaacatttacctttttttttttttttttgagacagagtctctcttttacccaggccggagtgcagtggcgtgatctcagctactgcaacctcaacctccccagttcaagccattctcttacctcagcctcacgagtagctgagactacaggcaaaacccaccacgcctggctaatttttgtgatttttgtagagacaggatttcgccatttggccaggcttgtctggagctcctgacatcaagtaatccacctgcctttgcctcccaaagtgctgagattacaggtgtgaaccactgcgcctgtccaggttttacttttattaaagaagcacaaactgaatcaaaaaagtaaagtttaaggtgaaattaaattaattctctgatgtttcaattatattataggctgataaaaatttcagaatgtggccaggtgcggtgacttacacctgtaatcccagcactttgggagtccaaggtgggcagatcacgaggtcaggagtttgagaccagcctgaccaacatggagaagccccatctctactaaaaatacaaaaattagccaggtatggtggtgcacacctgtaatcccagctactcaagaggatgagggagaatcgcttgaacccaggaggtggaggttgcggtgaaccgagatcgcaccactgcactccagcctggacgacagagggagactccgtctcaaataaataaataaaaaaaaaaataaataaaaataaaattcagaatgttaggtaaaaatgattttgatttaaaaaaggaaatatgttaacaattagttaataaattgtagtttatttggtagaagatatattaagacatgggatccaaaatgtaattagactatgattgaataaggtaatatttaacctccctttaaacttaaaatgacaagattcttcataactttgagttgcttctttaggtttcagagtttaaaattcaaacttccacttttggacccatatgggatctcaagtttgatacatgatacccagagccgattttctttcttctctttctttcttttcttttttctttctttctccttccttccttccttccttccttccttccttccttccttccttccttcctccctccctccctgcctccctccctctctctctttctttctctttctttctttctttcaaataggctggatggacaagagttatgaaaattctggattttttaaaatagtttgtttttgaaataaaaatgtcaaaagacaaaaaatatacagtcaagacctataggtattgtattattgtttgtttgttttttagtattcagttggaaggcaggaattcctgaagatatactaaacttccttctgaaatattcggaagaaaataaaaagatataactgtagaaaacataaactcaaacatgacattatctgaattctgcactattatattaattgcaaaatgttccctatactccatcatttctgtgcattgtcctcaatttatatacaaggaaactgagacttaaggaccagaaataatccaaaagaaatgaacgtcagtgtggcttagtgaagactcatattttttaaccttgagaagaatagaagctagaacaggaagaactcaaagaacagttgtggtcatcacaatcaaactcattgttcccagaaatatatttgacaaaacttgagagtagtatttattctggttttattatatcaaattgcttttttctcaaagactttataacatgatgtgtattggaattacaagtaagaatagttctgaatatatatttgtttattcacccatttttgcattcaacacctatttcttgaatacattcctgtctcaagaatctaaaaatttaagatacagagggaaaccagataacatagttgtttccctcaaagagtttacagggtggtggagaagacaaatgttagacatataagcccagtgaagtgtgatacacactataatcacataatatgtaagcatattacataatagaattaagtgattgtagaaagttcctaaaagaagtggtatttaagctaagttctgaaggacaaatatgcattaattagaaaccaaaaggtaatgattgagtgtgattgatgacattgaactcaatgaaatattaatgtgttcaagtgccaacagctacatttgctacagtataaagatatgattaacacttgacctactttatttactgaactcttgaacttcttaaagtcaatccaaagtggtcctttaacataattgttttcaaaccttacagggaattgttgccatttccagatgtcagtgattttcagaaagtgcttcatgttgaaatgaaaatctactcaattacatactaaatcacatttcacgagaaaacacattacataactaaatgaaaataattatgtacccttcaatgagactatgaattttcttaacaatattaagtttttaaaaaacattttgatgatacaaaaattacattcttaaatataagtaagtaaaggtagtcagaataccatggaaaatagtcttctctatttaaaattcttgtaatatgaattgaacacattagattttataatggactctagtaattaaaaaattgatctaactataaacatatcgatttcctaataaaaatataaacctaaagccccattatatcatataaatatgaaataacttctagtaatatggtagactgagttggtgtagaatgacttctcccctgacccacaactacccaataacagtagatagaaattctggataacatgtaacacaagcagattaatagtgtcatcatccatctgcaaagaggagggaatggagaaggtagggggaaagaaaccttcaagatgtcagctacaaaaatattttttccaagtggcaaaatgttaccaatgttctagcttctcacatagttgggggtaaggttgagggtggacgtggtggggaggaaaccattaaaaatgagcttatagctaaaatcacaaccaaagttgtgatctactctgaggcataattaacaggatcaagaagtaggagaatcaacatatagaaaaatacaaacatgatacttttttatatgtgtcagaagttactaaaaatcaagaaagttttatgactagtaattatttatttttaattttatttttattatactttaagttcagggatacatgtgcagaatgtgcaggtttgttacataggaatacatgtgccacggtggttggctgcacccaccaacccgtcatctaggttttaagcctcgcatgcattaggcgtttgtcccagtgctgttccaccccgtgccccacatctcccaacaggcccctttgtgtgatgttccccttcctgtgtccatgtgttctcattgttcaactcccacttacgtgtcagaacatgcggtgtttagttttctgttcctgtgttagttggctgagaatgatggtttccagcttcatccatgtccctgcaaaggacatgaactcattcttttttatggctgcaaagtattccatggtgtttatgtcccacattttctttatccgttctgtcattgatgggcatttggtttggttccaggtctttgctattgtaaatagtgttgcagtaaacatacatgtgcatgtgtctttatagtagaacgattaataatcctttgggtatacacccagtaatgggattgctgggtcaaacggtatttctggttctaggtccttgaggaatcatcacactgtcttccacaatggttgaactaatttacactcccaccaagagtgtaaaaacgttcctatttctccacatcctctccagcatgtgtttcctgactttttaatgaccaccgttctaacaggtgtgagatggtatctcattgtggttttgatttgcatttctctaatgaccagtgatgacgaactttttttcatatgtttgttggccgcataaatgtcttcttttgagaagtgtctgttcaaatccttggcccactttttgatggggttgtttgtttctttcttgtaaatgtgtttgagttccttgtagattctggatattagccctttgtcagatggatagattgcaaaatatttctcccattctgtaggttgcctgttcactctgatgacagcttcttttgctgtgcagaagctttttagtttgattagatcccatttgtcaatcttggcttttgttgccattgcttttggtgttttagttatgaagtctttgtccatgcctatgtcctgaatgatatcacctaggttttcttctagggttttcatggttttaggtcttacatttaagccttcaatccatcttgagttaatttttgtataagaggtaaggaagaggtccggtttcagttttctgtatatggctagccagattttacaacaccattgattaaatagggaatcctttccccattgcttgtttttgtcaggtttgtcaaagatcagatggttgtagatgtgtggtgttatttctgaggcctctgttctgttccattggtctatatatctgttttggtaccagtgccttgctgttttggttactgtagccttgtaggatagtttgaagtcaggtaacatgatgcctccagctttgttctttttgcttaggattgtcttggctatgtgggctcttttttgattccatgtgaaatttaaagtagtttttttttattctgtgaagaaagttaatagtagcttgatggggatagcattgaatctatacattactttgggcagtatggacattttcacaatagcaattctttctatccatgagcataagatgtttttccatttgtttgtatcctctcttatttccttgagcagtggtttatagttctccttgaagagatccttcacatctcttctaagttgtattcctaggtatttgtagcaattatgaatgggagttaattcatgatttggtctctgtttgtgtattattggtgtataggaatgcttgtgatgtttgcacattgattttgtctcctgagactttgctgaagttgcttatcagcttcaggagttttgggattgaggtgatgggtttttctaaatatatagtcatgtcatctgcaaacagagacaatttgacttcctctcttccaatttgaatgccctttatttctttctcttgcctggttgccctggcaagcacttccaatgctatgttgaataggagtggtgagagagggcattcttttcttgtgctggttttcaaagggaatgcttccagcttttgcccaatcagtatgaaattggctctttgtcataagtagctcttattattttgatataagttccatcaatacctagtttattgagtttttagttgttgagtttgatcaaaggccttttctgcatgtattgagataatcatgtagtttttattattggttctgtctatgtgatgggatatgtttattaatttgcatatgttgaaccaccctgcatcccagggatgaaggcagcttgatcgtggtggataagctttttgatgtgctgctggattctgtttgccagtattttattaagaattttcgcatggatattcatcagggatattggcctgaaattcttttttttgttacacctctgtcaggttctggtatcagcatgatgctggcctcataaaatgaggtagggaggaatccctttctttctactgttatagtttcagaaggaatggtaccagcacctccttgtacctgtggtaaaattcggctgtgaatccatctggtcctgggcttttttttggttggtaggttattaattactgcctcaatttcagaacttgttattggtatattcagggattcagcttcttccttgtttagtcttgagagggcgtatgtgtccaggaatttatccatttcttctagattttctagtttatttgcatagaggtgtttctattattctgtgatggtagtttgtatttctgtaggatcagtggtgatatcccctttatcatttttttattgtctatttgattcttctcttttttcttctttattagtctggctagcagtctattttgttaatcttttcaaaaaaccagctcctggattcatttattttttgaaggattttttgtgtctctatctccttcagctctgctctgatcttagttatttcttgtctactgctagcttttgaatttgtttgctcttgcttctctagttcttttaattgtgatgttagggtgtcgattttagatccttcccactttctgatgtgggcatttagtactctaaatttccctctaaacactgctttaactgtgccccagagattctggtaccttgtgtcttagttctcatcgatttcaaagaacttatttattctaaattaattttgttgtttacccggtagtcattcaggagcaggttgttcagttttcatgtagttgtgaggttttgagcgagtagatgcagtttcttcatagtgtcattggtctttatattttggtatgtctttgcagtggctgacaccagtttttcctttccatatttagtgctcccttcaggagctcttggaaggcaggcctggtggtgacaaaatcccgcagcatctgcttgtctgtaaaagattttatttctccttcacttaaaagcttagtttggctggatatgaaattcttggttgaaaattattttctttaagaatgttgaatattggcctcctctctcttgtggcttgtggggtttctgcagagatttgctgttagtctgatgggcttctttttataggtaacctgacctttttctctggctctccttaacattttttccttcatttcaaccttggtgaatctgacaattatgtgtcttgctgttgctcttctcaaggagtatcttagtggtgttctctgtatttcctgaatttgaatgttggcctatcttgctaggttggggaagttctcctcaataatatcctgaagtgtgttttccaacttggttccattctctccgtcactttcaggtgcaccagtgaatcgtaggtttggtcttttcacatagtcccacatttcttgaaggttttgttcattccttttcattcttttttctctaatcttgtcttcacgctttatttcattaagttggtcttcaatttctgatatcctttcttctgcttgatcagtttggctattgatcgtatgtatgcctcatgaaattcttgtgctgtgattttcagctccatcaggttatttgtatttttctctgaactggtttttctagttagcagttcctgtaatcttttttcaaggttcttagcttccttgcattgggttagaacatgctactttggaggagtttgttattacccaccttttgaagcctacttctgtcaattcgtccaactcattctccatccagttttgtgcccttgctggcgaggagttgtgatcctttggaggaaaaaaagacactctggcttttggaactttctgcatatttgtgctggtttttcctcattttcatggatttatctagctttgttctttgatgatgatgacctttgggtggggtttttgcatggatgtcctttttgttgatgttgatgttattgctttatgtatgttagttttccttccaacaggcccctcttctgcaggtcagctggagtttgctggaggtccaccccagaccctatttgcctgggtatcagcagcggaggctgcaaaatagcaaagattactgcctgcttcttctggaagcttcaccccagaggggcaccagcctgttggcagccagagctctcctgtatgatgtttctgttgaccccttctgggagttttctcccagtcaggaggcatgggggtcagggacccatttgaggagccagtctgtcccttagcagagctcgagtgctctgctgggagatttgctgctctcttcagagctggcaggcaggaatgcttaagtctgctaaagctgtgcccatagccgccccttcctccaggtgctctgtcccaggaagatgggggttttatctataagcccctgactggggatactgcctttctttcagagatgccctgctcagagaggaggaatctagggaggctgtcaagttccagtggctttgcagcactgtgctgggttccacccagtctgaacttcctggttgctttgtttacactgtgagggaaaaactgcctactcaagcctcagtaatggcagatacccctctccccaccaagcttgagcatcccaggtggacttcagactgctgtgctggcagcgagaatatcaagccagtggatcttagcttgtggggctccatgagtgtgggaccccctgcctgaccaagaccgcttggctccctagcttcagccccctttccaggggagtgaacggttggttttgtctcgctggggttccaggagccactcgggtatgaaaaaaacttttgcagctagcttagtgttgcacaaacagtgcccagttttgtgcttgaaacccaggactctggtagtgtaggcaccctagggaatcttctggtctgtgggttgcaaaaaccgtgggaaaagcatagtatctgggccagattgcaccattccttatggcacaatccctcacagcttcccttggataggagagggagttccttggccccttgcactttctggatgaggtgacacccccaccctgcttttactcaccatccatgggctacacccactgtctaaccagtcccagtgagatgaaccaggtacctcagttggaaatgcagtaatcacctgccttctgcattggtctcactgggagctgcagactgaagttgttcctatttgaccatcttgccagattctcccccatgactagcaattgtagtatcataaaatattagcttgaaatgagcaagttaatacacttggtatgctgcccttactttaagaaaatgataaagaagtaaattgacaaggtgattttgtttttcagttttgatcttacccagtgccacctctcaaaatatgtatacatgtacttattttattgttttgattgattgtgaagaatcagtttttaaccaaaataatatgattttattaaatgacactttctcacaaaagccatttgaagcaatgcagaatgggatttttctctgaacatgtcaagttctgggagaacatttttagtgtaataggagaaaactatattttatctattcaattctgtcatgcaaattggaaaagaacttctgaaggaattacataggacttcaaaatataatactttcagcaagttaattgcatgaattaataacaacattttcagacaatcaaatcagcccactccactatgatataagcacgaaaagcatggctccagttttgtcatttgtgtgaccaacatataacactgattaaagcttgtcttggacaaatgaatttcagttattcaaatgaacagatataacagcaatgtatattaatttgaaaatgtaatttcacaagaaaatataacgaatatttttcaaaaaactacaagtgagagcttttctatgagaaacccagttagctttattattagatagtagctgttggtaatcacactgtttacacagctgaggaaggccatggattcagtgctttgctattaataacattaatagttgcactaagccctcgtcaaatgtcagacctttctcaggcttccctgtgatgcaaaagtgaagatgtgataataaaaatgttaatgctggtgatcattgtgaataagtccatatatcttcagaatgatgattttgcgcatatatgctttggtttgaatttcctctgaagcagatcctgagacaagaagttaagagcaaataatttctctgacaggtgcaaatgacattggtaaaattataggaaagtgttacagggaagagaagcagcaaaaagtgtgataacaagccaggaaccgtatgaatatctgtagctctgttctacaggaagactcttaaccatgatgaaaagcacagacctcagaattacttcacaagcaggccaaggaagccagataattatacatacatttcctagaaccattgattgagaccttctctcagaggttattaataccctggcacttccatcctacaataaaacatggataaacagctttctatggctctgtaaaatgccttaggctcaaatatgtatttactggcaattggaacttggtggaaacacaccaaaatagtgagttctgaggaacatgggtggggcactgagaacatctgctgcaactgacaaatgatttagctaattaaacaatgcattttaatgagttatctatgattaattccaaataaaagtagcatcgtatgaaatcagctcacaattgtttacacattcttttgctgattagcaacatcttaatgatatagtgttgaaaagaatgcttttatatatattgaaattctgcatattagaattgataatagtaagccatcctgcactttttaatttatatacgactactcttgggctccaaggaaccaaaactccaactgaaggagcttaaaccataagaagattaactattttgtataagaagtcctaacacgtgatggataccgaaatggttggctcagcaactataacaatatgagctaagattcatgagattcattgcctctttagcaggtggactttggcccttaggacagacatacccatgattacaaggtaggttttggagacccaaaacttacgactgaagcaatgcacaatagaagaaaggtttatttctatctaggtatctctttaggaatgaagaagttttgttcaacatcaccaagcacaacatttgtttatattcattttacataatttacttttaatactgatataactaatatatgacacaatttgccattttgaagtgtacaattaaaaaattgttggtatattcacaagattgtgcaaccacctaattccagaacattttcatcatcccacaaaaaaacacaatacccattagcatttacttctaatctactcacccgtcctctgtaactactatctacattatgagtctatgggtttgtttattttgggaatttcatagaaatgaagtcatataatacgtggccttttgtttctgtcttctgtcacttagcgtaatgttttcaaggttcattcatgttgtagcatgcatcggtgtttcattcctttttacgacaaagtaatattttattgtagtagtaatagcagtagggagaagatgagaaggatgaattataatagtaatagtagtaagtagtagcaacagcagtagtaatagcattcaagaccacagttagtttattcattcatctgtttatgaacatttgggttgtttccatatttatctattataaattatgctactgaacatttttgtaaagtttgtatgtgaacatacgtttttagttctcttgcatatgcatatgcagaattcaaattctttattatatggtaactctgtgcttaagttttgaggaactgccaagctgttttccactgtggctgcaccatggtacattctcaccagcaataaatgagaattattccattttctccatatccttggcagaatttgttattgtctgtttttctttgaatatagctattccatatggatatgaaatggtgtgacattgtggttttgatttgcatttccctaattactagtgatgttgagcaacttttcctatatttattgaacatgtacatatgaattttagtgaaatttctattaattgcttccccatattttaattgggttatctttttattgttgatttgcaagtgctctttatatattctagatacaaaacatttatcagatatatgatttgcaattattttctcccattcaagcattctattttaactttcctaacagtattatttgaaacacaaaagctttagatattggtaaaatcctattaatgtacatttttcttttgttgttcatgctataggtgtcaaatctaagaaaccactgccaaactcagggtcatgaagatttaaccctgtggttttttttttccctaagagttcaatacctccaatgcctccattgtggtccattttgtgttcatttttgtgtatggtacaaggtaggggtttaatatcactcttggatgtaaatatccagtattccagcacaattctttgcaaggctatttttttccacaatgaatgttctagccagggatgtccatttggtttctgtgggccactttggaagaagtattgtcttggaccacacataaaatacactaatgcgagtccaggcgcggtggctcacgcctgttatcccagcactttgggaggccgaggcgggcggatcacgagctcaggagatcgagaccatcctggctaacacggtgaagccccgtctctactaaaaatacaaaaaattagccgggcgtggtggcggcgcctgtagtcccagctactcgggaggctgaggcgggagaatggcgggaacccggggggcggagcttgcggtgagcagagatggcgccaccgccctccagcctgggcgacagagccagactccgtctcaaaaaaatcaatcaataaataacaaatacactaatgctaacaatagctgatgagctagagaaaaaaaaatgcaaaaaacccacctcaccatgttttaagaaattatacgaatttgtgttgtgcgtattcaaagccgccctgggccacatgaagccagtgggccgtgggttggaccagcttggtctagacacccaagttgaaaatctattggccaaagaggtgtaagtttatttttggactctcgattctattccattgatccgtatgtctaccattttgccagtgctgaactttcttgactattacaggtttgtagtccattttacattcagaaggtgtaagccctccatttttttttctttcaaaattgttttggctatttggggaacttgcattatcttatgaattttacagccatcttgataatttctgcaaaaaaaaaaaaggcaggtaaaattttaacaggtattgttttgaatctgcagatctatttggatctattggagagtattgccttcttaacacgttaaatcttccattagataactacaagaggcttttccacttatttaagacttccttaactttggtcaacaatgttttgtactttcattgtaagacttggacttcttttgctaagttgatttctaactttttttatgctaccgtaaatataattattttaaatttcattttcagattgttcattgctatgatttaatgcaacagaattatgcatagtgatcttgtatccataaccttgctgaactctcatttattaactctaatagtttctttttggaggattgctttatcttaccatctgcaaatataagtaattttaacgttttctttccaatttggttgcctttcctctattttccttgcctaatagtcctgtctagaacctccagcacaatgatgtatagaagcagtgagagtggacttctttgtgttatttttgctttggggggttaattatctggttttttttacagtttaggatgatataagattgtggttttctataaataacttatcagattgaggaaatcaccttccattataagtttgttgagtgtttttaccatggaattattttttttttctgcaatcatctgctcatttggcttactggctaatctattacctcagcatagtgtattacattgattggtttttgtatgttgaatgaaccttgcattccaggataaattttgctctgtcattgtgcaaaatcatttacatatgctgctgctggattcagttgctgttattctgctgaggatttttgtgtccatatttgtaagagatattggaccgtagtgctcttgtaatgtttttgtctggtttaggtgtcagagtaattacggcctcagaaaatgagttataaattgtttctcctcttctaaactttcaaaagggtagtgaaggactggtcttaattctataaaagattgatagaattatccagtgaatatcccttagtcttgagctattctttgagaaaagtttcgattactaaaccaatttcttacttgtaggtttataaatattttctatttttctgcagtcggttttattagtttatgtctttccaggaatttctttttaatatcacttgttggcatacaagtttttatagtatttccttataatcactttttatataaggtcattattaatgttccctctttgattctgattttagtaatttgaattttctctctgttttcatggtctgtcatggtaaagtttatcagatttgctaatcttttcaaaaaatcaacttttgattttgttgattatctctattattttttctactgttcattttattcacctctggccttatctttattatttccttctatccaccagctttgggtttggttttctcttctttttctagttcctcaaggggtaaagttaagttatcgttttgtaatctttattctttatttttgaaggtgtttacaccttgtactctctgcctgccttgcttctcctacattacagcatgttatgttttcattttcattaatatccaagtattttctaattttccttatgattttttctttgacttattagttgtttaagaatgtgttgtttaatttacatgtagttttaaaacttccaactttccatctgttactgatttctatctttattgtagttggaaaagatactttgtaagctatcagtttttaaaaatttattgaggcttgtttgtgacctaacaaatctgttctggaaaatgttctacatgcacttcaaaagaatgtgtatcctgaagtttttaggtgaagtgtggtctatatgtctgtaaagtgtggttggtttatagtgtcattcaaatctatttttatattgaacttccatttagatatcctatgcattattaaacattgattattacgtcttcaattactactatagaactatttctacctttcattctgacaatgtttgcttcatagattttgatgcacttttgcttgatgcacatatttgtttttttttaattttattattattatactttaagttttagggtacatgcacacaatgtgcaggtttgttacatatgtatacatgtgccatgttggtgtgctgcacccattaactcgtcatttagcattaggtatttctcccaatgctatccctcccccctcccccgaccccacaacagtgcccggagtgtgatgttccccctcctgtgtccatgtgttctcatttttcaattcccatctatgagtggcacatatttgttaatatttttatttcttcttggtgatttgacccttttattaacagataatatccttccttgtcttttgtaacaattttgacttagagtctattttgtctgatattagcatagccacaatagctcttttttagtatatatatgcacacacacacacacacacatacatataaaatctttttctgtacttttacatacaacctagttatcactttggatctaaagcgagtctgttgtagacaaaatatatttggattttttcccattctgcaaatcattatctttagattgaggttttggtctatttacatttaaaaatgttactgatagagaggaagttatttttgatgttttgttatttgtttctttatgtcttaaataattttgtttttgttcttatcagtcttcatttcttttattattgcattctttgtgcttagtttatttttatatcctcctaatttccttttatgtatattattgtattggtcagggttctctagaagtacaaaactaagagtacatatattaggtatatatatgtgtatatatactatatataattatatatgtatctaatataatatatattttatatagagtgtatatatataattatatataatgtcctttcatctcaacatgaagattctcttttagcattggttatagggtaaattttgtggtaatgtacttcttcatgttattaaggtgaaatgtcacaatctctcccatatatatatatatatatttcccatatatatatatatatatatttcccatatatatatatatatatttcccatatatatatatatttcccatatatatatatatatttcccatatatatatatatatttcccatatatatatatatatatatatgagtttatatatgtatatgagtttattaagtattaactcacatgatcacaaggtcccacaataggctatctgcaagctgaagagcaaggagagccagccagcccaagtcccaaaactgaagaacttggagtctgatgttcaggggcaggaagcatccagcacagtctaaagatgtaggctgggaggctaggtcagtctagtcttttctgcctgctttatattctagccatgctggcagctgatgagatggtgaccacccagattaagggtaggtctgactttctcaacccactgactcaaatgttaatctcctttggcagcaccctcacagacacacccaggataaatactttgcacccttcaatccaatcaagttgacagtattaaccatcacaattattaacatatttttgtgtttatcattgagagtatacttaacattctaaatttataacaatctagtttaagttgatactaatataactttaatagcataaaaactatgcttttatagtttcattctctcttctttatgttgttgttgccatgttgtcacaaattacttatttatacattgtgtacccgaaaatacagctgtatatttttaaaagtttattttattttatagcttgtaagataagctttattagcagttgcaaactgataataccataatactgactttttaaattgcctatgtatttagtacaatcagagatctttaattatttatatggcttttagttagtctaatatcttttcatttcaacgtgaagattcccttttagcattggttttaaggtaaattttgtggtaattactttttcatgttattaaggtgagatatcacaatctctctcttatctttgaaggatgattttgtgggtatagaatttttggttgacagttgttgtttcctagcacttttaatgtaacatcccactgttttcttgcttatatggattctgataaataattagctgttaatcttattgaagaatccttgtatgcaatgaatgtatttttcttagtgcttttaatattttctctttttctttggatttcaaaatttcataatatgtcttcatatgagtctctgagtttatcctatatggaggtattgaggattttggatttatagaatcatgtctttcattaaatttaggaagttgttagctatttcttcaaatatagtttctgaccctttctttctatattccaccttccacctccacccacacctgggaaattctataataaatatattgattcacttgatggttttcacgggcccctccattctctgactctttcctttgtctgcctgaatctatggttgaatgcctctagtaaatttctcattttacttattgcacttttcagctccaaaatttctgctttgtttctttttataatttctcttcattgatattctcattttgttatacacaatttttctgatgtcctttaattctttatctatattttctaatattgtctatgttttcctttccttggccttgtgatttttctgttaaaacttggacattggaatattatgatgtggtggtcctggaaataaaatctccccctttatcaggggtttgcatttttcaatattattaaggctgttatcctccatttatttagtgacttctcgaaactttatgcaaagacggtttcttgttgagtgtgatccctacagtctgtggtttcttgtttgtatttacttagtgttttaaaagagattcatttaaattccagaagccaagaacaaatatacagaagaataaaaaaaaaaccctcctccagtctttgcatcttgggtctatgtaggacactttctcaatatttagccaggcttgcactgaagttttagcttaagatgaaaacttatgaccttctcagatttttctctgagcatgcatcttatcctaaacaaggtttctaatatagattttttaaattcccttcacacacaagtctttttggatgtcctaattttttgaagatactctcccagcttttgatcctgggtcttacacagtctattatatgttttgactgtaatcatttggcccagaaatcttggttggttagtttgctttgcagtgtttttgagcaatgcccgtcacttttccagcctatgtttagaggtaggtaaaacaaataatagtgtccttaatcaacctccccgctatcattcaggcaggttagaatagaaatacacaataatctgtacataaggtctttgctctttccagagcaagagatcaggattccaaactgggaacccaaggtttcctcttcgatttgtgctgtgccagagagtggtggcaaaaatacaagtaaaaatgtcataaagctttcctatcattttggagttacatttcttgattcattgtttgcctaactgctgtaaacctttgactctctcccagagttttgacaaacttggttctgacactttctgcttggtttccaatgttttagctggggtacagtagcttgaagccatcattttgctgatgccactgctttggctatgagtgcattgtcttggttcagagaaatcagaatgtatgtctcagagcttggaataaggccatccactccaaaaggacaatgttttaaagagaaatgtagctggaactccctgtgtcaccattacttagttttatgttcaggaaactttgtctagaaaaaaaaaaattagaccacctaggttaagatgtctcaattgtattttccaaaaaactttccctaagaaagctaaaactacatataaatactttttttttttcttcagggaattcttgaatataagggtatcttagataactatttgctcaccttaacaacctgcatgcttatcaaacaataaattacttatcaaggattacttaaagacctttgccttactatgtccatcaagcttaagttgttatcttaaatgttgtcctacctcaataatttattttccctgaaagaccttccttaacacgtgtaaattcagaccccaagttctgtaaatacccagcttattgcttctccttctgaaaaactggcaaaactctgtcaggctggtgtctcctttattgcatgttttttaaaaaatgttaattttgatttatgaacagattggtgatattttgaagaattctatattaagtgagcaacagtgtacattacaatgtctaatagttacagtagaagttattgaaacttcgaaacattaaaaagtgtgtttgagttctgtacctgcctgtagattttaacatctgcttaacttggagtattataataatctaatcctgaggacttcataatttctaatgtaatattacagtttacatatattgatggttttaaaataatttacaaaagttatgtttttttgataataattctgttccacaaaaaaatcgtgcgtatcatttttcccaacctttgaaaaccttgttgctagattatattatgaaaaactagcaaataagtaattgcgaccacttagcaagtgttaccatctgagttgccacaagtatcaagtaaacttcttcgagagtataatatagattgtaaagcagcacgtttgtatccacagatagaattatctgcccaccaaagatagtgaagtgattagtgtcacctcttgcatcgtgaatagttggatggatagagttggttgagattgctgaggtgcttattattaacggcttaactcttaagtattttctctctttaaaatttcccattaaactaccgcacccactggttaatttcagtattagttagctttaagtttcaagttaatagaggaaaaaattttatgcgctttctcctcctatactggaagaggaacatgaaaccgaaacgcaaattctgggtttaatgaatctaagataaatcagtatcttcaaatggcaatataaaaagatggagagctgaagacataataatagactaagcagaaaaccaacaattgtgaaattttcttccttggtgaagaaaatattaacaaagtatacactgacttactccgggaaggttaacgttttgaggcacaggttgataaaaatactgtaatttaagttggtgttggatatgatgaaaacagacactgtttaaaagtctgattatagaacaagaagaactcaagactgcaagttccattattcatgggcaggtggataaatcttccacatttcaagagatagaagatttaatctttgaaataattcaattagctactcccaacttcaggatccaaagaagtcagacactgctttctgaattatgagacttgagttctcattttcttcctaacttttagaaaaatgacagagagacttttccttcaaggaagaatataggtgtatccttctctggctaaacaggacaactccaggtaagagacacatagataattgacatttgggagcaacaaataaagttcaaacaaattgccaaagctggccagaatttgaggaaacactccaaggtgggaaatgaccaaataaacacactttttaaaaaagaaaagctttacaaaaaatctcaggatgaacaaggctttacaaagagtagaacacttcaaaactgtataatctgtaccccttgggaaaacccaaaataagagcagaggaagctatacaaaagctataaaaattgcaattagagatcaagataagaattttagaaactcgacaaatgagtagataaaattagaaacatctgtgaaattttgcaggatataaatcaggaattcttttgaaaattagggggataaaaatcaagaaaatagtagagaacatataagaaaattgagtgagttaggcagaacaatatccctctaggagatgtctcagaaagagacaacagaggaaatactggggaagaaattaagaaggaaataatacaagagaaaacaatctcagaactataagaaataagtctccacattagaagggctcaccaagtgtccaagaaaatgaatgtaaaaggattcactctgaggcatgtagtcatacattttcttcaaaatactgcttataaaacacatatcctgaaatcctccagatactgataataaaaaagtttcatacaaagaataggaaatcagcatgacatgaggctctttatctgccacaccaaatgaaagttagaagacaatggataaaatgccttcagaattcagacagaaatgattttcctctttaaaatgtatttactcaaataatatgactgaatctggatttcagtatgaaggtagagtaacaatgttttcagatattcactgtctcaaacattttccttccatgcaccctttaaataaaaattgaatataggatacaccccaaaaataatgagaaaagaaagaaaggggaaggataggattcaaagaacagaggatctgttgcaagaaagagatcaagagaattcccaagatgaggtcaaaggaaatattgtgaaaagagcctgacaacaggtttaaataaaagcaactggtatattttggagcagtatgaaagtaaccccagaaaggatatctacagaggaaaaaataaaattgacagattttctgacaggtctgtctatatgaacattttattgggaggacttttcggattttttggatagtataaaaatttggcaaaagatccaaagactattaaacaataaaaatgaataatgtttaactataaggaaaccaacaggggaagtgaaaaatatgaaagtataattgtagtaaactatgactcaatagtgaacaatatctattatgatgtcataataattaaaacactgattatggcattaagcaaagattgtgatataactacattttgaaatataaaggtcgggaaagtagacagtaagaaagcttaaatcctcacttgccaaagtagaaaatttaatgaataatgtcaatgtacatctatccaccaacataagcatgttatttggaactatagaagcaagatccaaaagtttctccttccatgattggcgtgatgggagcaggaaccctggtgtttattctatgcacttagcactattgaatgctcaaaatgttttccttgttttcctttgataaaatattaattaattaaaaattgtttggcaccagtacatgtgcttggccattgtgagaagtgctaagaaaaaactttgttctgaattaagaaattgggttaaaagcaagatgcccaaagagtttggctttaaatcttgagttctattccacatatctgtatctgcttgaacatttatttactctctttacttcatatgcaaatatcagataattttactacttaccttgtggacttgttgattcttctcacttctttgttaaggtagcaagataatgatgtaaaatgctgggcacaggaatagcaactgtttaatgaatgaatgactgatgatgatgaagactatagggaaaatggtgatgagacaatcataaatccaacaaaacattcattatttcccaagcatcctcaaaaattcccaaactatacagtaacctactttattctctattcttttataaaactgtatctgatagtatcatctttattgtcatcaaaatggctgataaagtgagaagcattttcataaagacatacaaatttggattatcctaatagtaattaataccaaagttatttggatgtgtattttttcatcatttttcttaattttgacaccattttttgttgacatttttaatccaagtcaatatttttcattcactttgactattcaacgtttttaatatgcatctctatttaaacttgaagaagtctccacacatgtaagatatacacaagtgggaaggtggggaaaagaaagatgcccccagtgggtggattgtttgataaggagtgggttagaagaaggcagataaattatctattactatgattttttaataaaacattaaagaagggtgtaaagattgaaagctaattgttttttgcctagtgagattctgtccttgccattttgactaatgtttcctcaaacattagtttcagaaatcataccatgatttgaggctattaattcccaggaaaagagcatatgacattttgctgctgaatcttgtttttaattactaattacttaaggagatatgagaagcatatagtggcttttaatttcttttccagtttacaatttaaaaaattagtttaaattatttacagagaagatagtgtcacattagtacactaaattgaaatagaattgtattccactgccttggcttcaaatgacttagtgtgcttgaaatgattacctgtatatggatggctaaatagagaaatattaggtgtttagtatgttgtgaacttcttcctggcctatttattgcctaagtggcacttaagaaaattagacaaaattttgcactaagcctgatgcataatcaatctattcaataattcccactatgccttgaccttcataaggtcactccactgttgacaagtcttgtctgtaacttaaaattacagacagctgggtaagcccatcgagtgtcatggacacatctatttgggcacttcttcaatactttgactttgaaaaactttcaattcaccaactggtatcagtggtctaaagagggtcacttcttgattatttgacagctcctggaaatctctgtgttttttttttgcttctctctaagaataattatagatataaaggcttggaattcattttaaacctgtgatagtgtgactacagttcaacataaagattgataatgtagtgtctgttatgactcatatcttagccagtttttgttccccaatgtcagttttcatgttatacacatttccttttagttgagtatgaaaagtagagctagcaacatatatttggagtttttgagtttgtaggcatcattacaattgtaataattttatactcactgagagggccacagttatgttttaggtatattgtaattgcctatgattcctagctttggttggcactgctatttggacattagttgttgatcatcaacctattcacaaattgttattcaacataatggaatattctgaacaagaaattttgcaatgattgtgaaaagttcatacattttggctgtgttgaccatgggcttcagacttgtttccaagaagcatcaaaataattaaaactaaatttcaggcacaataaatagccatgtcaacttccatatctacatgataaagtgagaacggtttgggagtatacagctgggtgcataaacttacaagggagtttctttgaagaaaacaatatttttctcttacaagaattaattcaaatgctgctggtttgtggtgctaaaaaaatgtttctagctacagtgttttaaattcccctgaagaaaacaaaatgttttatgaatattaggattcagttttagactttcttacatttggaaacagggctacttgttggaggggttctcattttacttcacagtgagtgagtggctccagctgacttcttgggtgctttgttgaattggtggaataggtaatagtggtgaatgactaaacatagcagacataaccattagtaactcatagtgacttggaagacacctcaagggaaacagcgttcagccctttcatcttttgtagctaggccttcggtctttcagttgcaagaaacttaaattcaactcaaactaactcaaagaaaagagaaattaattgacccatatagtcaaggagggatttaggagtatttaccgaatagaatttttaaaaaacaaacagcagatgaattaaatatttagaacccacagtttaaccgtgctgggattttctttgaccttctcttgcttctgtttcttgctgtgtgttggctcaatttccttctagtgatcataagctttaaaacaaccacattttagcaacttcagtgggaaagcacatgatatttgtaaatacttatggattaatatcaagcagagagttggatttatccatcctttgagccaaccactattgtctgggaaataggttataatatttgctaactcctattgctcatcgctatgaccagagggctagtgcaaactacaggtggaagaatataaaagacattcttttgtaaaaacaggaaaaaaataacactgcctagcacgtccactgcaccacttcttgtgcaaacacctgtataacatccttacaggtactcctcagcattaactgggtaaaatgtaggatatgatgaaaagtttattagacctggcatctatctcatctctgtttctagccagttttgtggtgatgaaaaagacattttgcagctctgaactttatttcttcatccataaatttgttgctctatcattttcaatctctgtgaataggaattactgactgacaatctcattctgttgttgtagaactcagatcaagctccattgagctaaatgttgtctttcttgcattataatacagaaattaagagtgaactcttatatcagataacccttagtttgaatcctagtatgtggtactcagcaattcactcaaactctctatgtctcagtttcttcattgaaaggatttaattagaagatgtatataaagtgttggcaaaatgcctagcacatataaacactggataaatattagtcattgctcttattagtattattgttttcattattatttttaacttacaacaactggagtttggcttgtcaagagtcgtgcagaattaaagagtctgtctttcatggggacaaatctttctttccctcctgcttcaccatagtttacaattctttagagaagaggcgctttggatacttccccacataatacagacgatatctttcatttctaattgcccaggatcaaagactagttccacattaactaaacggccttaccattttaatgtgttttgaatcatttacaatccagagatatggaaacatagcaaaattttagagtaatggtaaaaagcacctgggaacatggtgtaggatggtgtaggagcaggtaattgagcacagacagttcatttaaatgcctagatcatgtaaaattatttacttggaactggcccaagtaatttgcaataaatgaccttattttttgcatgttgaaaactgctttttttttttgcttgagacaaaatctccctctgtcgcccagggtggggtggagtggcacgatttcggctcactgcaacctccacctcctgagttcaaaggattctcctgcctcagcctcctgagtagctggaattacagacacctgccgccattcccacctttttttttttttgtttttttgtttttttgtttttttttttggtatttttactagagatgagatttcaccatgttggccaggctggtctcaaactcctgacctcaagtgatccacctgccttggcttcccaaagtgctgggactacagacgcgaggcaccacgcccagctaaaaactgcttttgatcattaattttttgacatgtgctattatctggaagaaagtaataacaggtgaaaaaataattgttactttaaatgatgtcttagggacagccaagacataccattagctagggcaaaaatttattcaaactacttcagaattatgtagacagtttttttgtttgtttgtttgtttgttttttaatgggatgggcatttttgatcaaatgtgcaaaatagcttagcgtcattttttatgatttttaattttctgtcttaaacttatatacttttttgaacagtggtattttaaattaatattaatgtggaaaattcagagcattcttgtttcatcatcttgacaaccaggttagactggtaaggtgggaattataatgattatcttcattttactaaaacaattttcccaaggttacacagctagtctatggccaacacagacttgcagacatacgtattataaccaaaagaaagtgttcttattaatggaaaatagggtaaggtatttgttctgtttttctaatgttgctttagattctttagacaaatcatctgtgctaaggttgcttataaaagcatctgaagatcaatggaattaagttgagacaattctgaaatgaaaattcaagtgatgaaattccccagagttcaattatttgagttaaaagtgtttgtaataacagatcttggtacatagttggcacatttctccgttgtgtttttcctctttctatcacctttcagtttctattacaacactcttagggagtttactaataaattaattattggaaagcatatattgcctgaaggtttatgtaccagtagccattagccacaatatgcctagaatagatatgtcatttcccggttgaaatatcgatccaggagaacaaatgaacaaattatcaatttggacatgccaagaaaaaaaaattgaatatgtagccatgtttatttgagacattttactccataaagcatgtttaataaaaagaatgagttcatgcaagaattgcaaacagccagtcagagccatgtgatggtactggaagttgttttacaaatgtatgttccagttcaggagcatcctctcttagtaaaaacttccttttaatagcagcatcttaggcacttgatccacagaaggaagtaattaaatttaatacatgcaacactcattttgaggacaccctcgatttaaagtagcggggggcataattaagtctaatagaaatcatggcttgagaatgaagatacactatcaagcaaacacagaccaagtctacacagaaccaattacctggttaattagggctacaagctgtgtttatttcatgttattcaaccaaagcaaagcttgagggttgatattgtttgtttatttatttagttggaattacatttataattggaattaaatgaatataaaccacaatattagatgagcttaatgctcatatatagccacccaaaaagaaaaacaaagaagtggaatcattaactaagtgtttttaactgaaagagtagatttggaagcatatatatacatagcctaaaccatcagaaaaaaaaaactatattcccctttccactctttatcataagtataacttcaattaaaggaaataactttgatttatagttagaccacaacatagtatctgttgtcctgtctgttatagatcaagtcagcttggtgtaatggaaacaactctggcttaggagttaagagttcgtggtttttatcatttcaattcatttatacttctgtttgtcagacatacgttgaccctacagtgtggtagtcagcagagggaaagatggggaaaataactaaaccaacaagatctaattcttaccattgaggagcttgtagaatactgttagaagtaaacatttgagaataattatggtaagatgtatttaatagtagaatggatgtttgtagaaagagttgtaagacataaaggaggaagaactgaaaaataaaacaggaatcagttactctgtattttcccggaccttaaagggtgataaccaaaggcccagggaagggcaatggaggtagagtcagcagcacatgcaaggacatgaacagaggcccaagacattcctttgagattccagattatatgggggatctgtagtaaaatgggcgtgggactaggaagctctgattgttcagagcagatgaaacctgaggtgaaaaaggaaaagggaggccagatgctgggtacatttatgggatatatgtaaggtttgactttaccttttggaaaacaatctttgaagccaagaagttctttatgttttgcctatattgttacctgaaccctgagaccttatacttccttttatccaaacagtgtctggtatactgtgtgttgaatgaatatgagtgaagaaataattggtaacaattagtattcaattttatatcataatttttaatttatgattttaaggatcatgcccttagtaaattagacacacagtggtcttcctggaatgcgtttatgcctagatacaacaccagaagcacaatgtaaattgacgataataaagaactgacacatgtgtcaagaaacagcaacgtaagcagttgtgcctcagagaaaggcatagagagttttagcaaaaagctgtgcattgggtaaaaatcatggaaaaaaagccaaagaaaagttaactcaggctctccaataatctgattgtgaggtttcactcacatcattcctctaagttttattaattaattatataagttttttgagcacttactgtgctcaaggacattagggcatgaagcaacaatggacactgttctcgtcctaatttggcttgcatttaatgggctaaagtcagcaaggactctttgagagcaagcaacagacaccaccgtgagttctcaccagccaaaacggacttaattagaagcacccagagtagcttacagatggaaagaaagatggaaatccaggccttggaaagaccagagatcaacaaaatagaaaattacgtagtaggaattaatagaatatggaatatatatacaatggaccatggggtgcagtgggggagcaattttgcaaaggagaatggaattatcactaacagaaaagatagggtatattgaataggcaaaatagaacgtttgtacaaaaaaaatctttttctttagataatttctgaggcgttttctggttgtaaaagttctggaagttggcaaaggatcatggtttggtgtttcctacttttttaaatcatatttttctttctttagaatgcaaccctgccttttgtgaatagaatttcataagtgaaggaagctggctttcatctcaaagtgaaactaaaaaaaaaaaaatagtaaaaagttttcctttcaaaagaagaggctgtgattgtctttaaagtagttctataaataagcattctgcagtctgtgacacactttagagaaagagcaaagttcagttctatagctcatttaaaaatatccttcttgagttgagatggtcccacagagatttattttcatggatttataagctctgagaaactgcagtttaaacataggctggctgaaaaatgcttaattactcagtttggtcactgaagcaacaacattagccctctagtcaaagaaaatgacagtgttatcaaaactaacctgcaaagctttattaaaactatctttggcgataatctcttttaagaatgcattgtttttaattagaccttggctttgaaagcaagaagggtcaatgaaaaaaaatttaatcatgtccaagctactgtgctacatctttacaaaattcaattatttctatccagtgtggcacaagaaacatttggcaactgattaaaacaattcttaaagcaaattacagcactgtcagaaaacaagaaatcagaatgtcaaaatacaaggacatttctatgcaaaatgtgttgcaagtgtctttgacagagtatttctgtctgcttgttttattactttcattaatttggtccacatcaagtaaaaagaaaaaaaaatacttccatgtgttagctatttgaaataaaaattctcaaatgaataatattcccaaagataaccaaagtagccatgtggggaaattttatgctttaattttatccaagcttactcagcactgtaaaaatctatgttgaggtttctagctgtagggatcccaaaataactgcttttttttttttttttggcagtaaatccacatctatgcaatttcagctactactaatatgtagatgccattagacgtagatgttatgtattatttcagggcagaataaaacataacaatatgtaatttataatatatttgatgtgcattttaaaaagtgaagttttttaaagtttagaatgaataacaagtttgtttttcttaattatgctttaagttctgggatacgtgtgcagaacatgtaggtttgttatataggtatacacgtgccatggtggtttgctgcacccatcaatccgtcatctacattaggtatttctcctaatgctatccctccccctgacaggccccagtgtgtgatgttcccctccccgtgtccatgtgttctcattgttcaactcccacttatgagtgagaacatgtggtgtttggttttctgttcctgtgttagtttgctgagaatgatggtttccagcttcatctatgtccctgtaaaggacatgaactcatcattttttatgtctgcatagtattccatggtgtatgtgtgccacattttctttatccagtctatcattgatgggcatttgggttggttccaagtctttgctattgtgaatagtgctgcaataaacatatgtgtgcatgtgtctttctagcagaatattttataatcctttgggtgtatacccagtaaagagattgctgggtcaaatggtatttctagttctaggtccttgaagacttgccacactgtcttccacaatggttgagctaatttacactcccaccacatcctctccaggatctgttttttcctgactttttagtagtcgccattctaactggtatttcattgtgattttgatttgcatttctccaatgaccagtgatgatgagctttttttcatatgtttgttggccacataaatgtattcttttgagaagtgtctgtttatatccttggcttgctttttgatgggattgtttgtttttttcttgtaagtttcttgtagatctggatattagccctttgtcagatggatggataggttgcaaaaattttctcccattctgtaggttgcctgttcactctgatgatagtttcttttgctgtgcagatgctctttagtttaattagatcccatttgccagttttggtttttgttgtcactgcctttggtgttttagtcatgaagtctttgcccatgcctatgtcctgaatggtattgcctaggttgtcctctagggtttttatggttttaggtctcatgtttaagtctttaatccatcttgagttaatttttgtgtaaggtgtaaggaagtggtccggtttcagttttctgcatatggctagccagttttcccaacaccatttattaaattgggaatcctttccctattgcttgtttttgtcagatttatcaaagattagatggttgtcaatgtgtggcattatttctgagacctctgttctgttccatttgtctatatatctgttttgctaacagtaccatgctgttttggttactgtagcattgtagcatcctttgaagtcaggtagcgtgatgcctccagcttcgttctttatgcgtaggattgtcttggctatgcgggctcttttttggctgcctgtgaaatttaaagtagttttttctaattctgtgaagaaagtcaatggtagcttgatggggatagcattgaatctataaattactttgagtagtatggacattttcacgatattgatttttcttatgaggatggaatgtttttccatttgtttgtgtcctatttcctcaagcagtggtttgtagttctccttgaagaggtccttcacatcacttgtgagttgtattcctagcattttattctctctgtagcaattgtgaatgggagttcactcatgatttgtccctctgtttgtctattattgtataagaatcacaagtataagaatgcttgtgatttttgcacattgatttttgtctcctgagactttgctgaagttgcttatcagcttcaggagattttgatctgagacaatggggttttctaaatatgcaaatatgtcatctgcaaacagagacaatttgacttcctcttttcctatttggataccctttgtttctttctcttgcctgattgccctggccagaacttccaatactgtgttgaataggagtgatgaaagaaggcatccttgtcttgtgccagttttcaaagggaatgcttccagcttttgcccattcagcataatattggctgtgggtttgtcataaataactcacattattttgagatacattccatcaacacttcatttattgagagtttttagcatgaagaggtgttgaattttatcgaaggccttttctgcatctgttgagataatcagatgatttttgtcatttttttttttacgtgatggattacatttgttgatttgtgtatgagaaccagccttacatcccagagatgaagcagacttgatcatggtggataagctttttgatgtgttgctggattcggttgccagtattttactgaggatttttgcatcgatgttcatcaaggatattcgtctgaaattttactttttgttgtgtctctgccaggttttggtatcagaaagatgctggcttcataaaatgagttagggaggagtccctctttttctgttgtttgaaatagtttcagaacgaatggtaccagctcctcctggtagaatttggctgttgatctgtctggtcctgggctttttttgattggtaggctattgattactgcctcaatttcagaatttgttattggtctattcagggatttgacttcgtcctggtttagtcttgggagggtgtatgtgtgcaggaagttatccatttcttctagattttctagtttatttgcatggaggtgtttatagtattctctgatggtagtttgtatttctgtgggatcggtggtgatatcccctttatcattttttattgtgtctattttattctgctctcttctcttctttgttagtctggctagtggtctattttgttaatgttttcaaaaaacagctcctggattcattgatttttgaagggtttttcatgtctctatctccttcagttctgctctgatcttagttatttcttgtcttctgtcagttttcgaatttgtttgctcttccttctctagttcttttaattgtgatgttagggtgtcaattttagatctttccctctttttcctgtgggcatttaatgctataaatttccctctaaacactgttttagctgtgtcctagagattctggtatattgtgtctttgttcccattggtttcagtgaacttctttatttctgacttaattttgttatttaccctgtagtcattcaggagcaggtagttcggatttgagtgagtttctgaatcctgagttctaatttgattgcactgtctgagaaactgtttgttatgatttccattcttttgcatttgctgaggaagtttttacttccaattatgtagtcaattttagaataagtgcaatgtgtgttgagaagaatgtatataatgctgatttggggtggagagttctgtagatatctattagatctgcttggctgagagctgagttcaagtcctaaatattcttgttaattttctgtctcattgatctgtctaatattaaaagtggggtgttaaagtctcccactattattgtgtgggagtcaaagtttctttgtaggtctctaagaacttgctttatgaatctgggtgctcctgtattgggtgcatatatatttaggacagttagctcttcttgctgcattgatccctttaccattatgtaatgcccttgtctcttttgatctttgttggttaaagtctgttttatcagagactacaattgcaaccccagctctttttcgctttccatttgcttggtaaatattcctccatccctttattttgagcgtatgtgtgtctttgcacatgagatgggtctcctgaatacagcacagagatgtgtcttgactctttatcaagtttacccgtctgtgtcttataataggggcatttagcccctttatatttaaggttagtattgttatgtgtgaatttgaccctgtcattttgatgctagctggttattttgccctttagttgatgcagtttcttcatggtgttgacggtctttacaatttgatatgtttttgcagtggctggtaccaattttcctttccatatttagcacttccttcaggagctcttgtaaggcaggcctggtggtgacaaaatacctcagcatttgcttgtctgtaaaagattttatttcttctttgcttatgaagcttagtttggatggatatgaaattctgggttggaaattcttttctttaagaatattgagtattggcacccactttcttctggcttgtagggtttctccagagagatcaactgttagtctgatggccttccctttatgggtaacccagcctttctctctgactacccttaacattttttccttcatttcaaccttggtgaatctgacgattatgtgtcttggggttgctcttctcgaggagtatctttgtggtgttctctgtatttcctgaatttgaatgttggcttgtcttgccaggttggggaagttctcctggacaatattttgaagagtgttttccaacttggttccattctcctgatcattttcaggtacaccaatcaaatgtaggtttgctctttttacatagtcccatatttcttggaggctttgttcattccttttcatcctttattctctaatattgtcttcacactgtatttaattaagttgattttcaatctctgatatccattcttctgcttgatcgattcagctattgatatttgtctatgcttcacaaagttctcgtgctgtgtttttcagctccatcaggtcatttatgttcttctctaaactggttattctagttagcaattcatctaaccctttttcaaggttcttagctttcttgcattgcattagaacatgctcctttatcttggaggagtttattacccaccttctgaagcctacttctgtcaattcatcaaactcattctccatacagtttttttccgtagctggcgagaagttgtgatcttttggaggagaagaggtgttctggtttttggaattttcagcctttttgcactagttttttctcatcttcatggatttatctacctttggtctttgatgttggtgacctttggatggggtttttgtgtggatgtcctttttgttgatgttgatgctattcctttctgtttgttagttttctttctaacattcaggcccctctgctgcagatctgctggtggtcctcttcttcagacttctgtgctggcagtgagaatttcaagccagtggatcttacctttctgggctccatgggggtgggatctgctgagctagacaacttggctccctggttcagccccctttccaggggagtgaacagttctgtctcgctggcattccaggtgccactggggtatgaaaaaaaggaaaactcctgcagctagctcggtgtctgcccaaatggcagcccagttttgtgcttgaaacccagggtcctgttgatgtaggcacccaagggaatttcttggtctgtgggttgtgaagaccatggggaaagcatagtatctgggccagaatgcacctttcttcacagcacagtccctcatggcttcccttggctaggggagggagttctccaacccttgtgtttcccaggtgaggtggcgccccaccctactttggctcacccgtgggctacacccactgtttaaccagtcccaatgagatgagtacctcagttggaaatgcagaaatcacccaccttctgcattggtctcactgggagctgcagaccggagctgttcctactcggccaccttgccagccaccctgaaaagtgaacttttaagttacataggtctgagccatgtgttctaaaatatattgttgttttgacttcaatttaagtgagatttgtgctttttaatagaaggttgcacatttttcttctcttttaaagcttaacagaaattcaaaggcacacattatagaaaagtgaagctctaggttgataataaaataagataaaccacaaaaaaatctgccttttattaacatagttcttgtcccatgtcaaaattcaagcactagagttttgtattcagccttattgagtcagttagctaactctatgctttgcttctatgtggctgcttgttttagtgaggcagagccttgactatagtagttatccaacacatttgttgaagtatattgagataaagagctataagaacatttgagcctatttgaattgcttggcaaagaactatatattcaatgttcacaaattttatggaattgggtcttcttaaatagagaaagaatttgaatcatggaggagtttctaattatgcctactatattggcaactataatgttgtataagtcagatctcttttaagtaataaaacctcagctgaaactggttcaagagatagacaatagatagatagacagatggacagatagagttttttagctcaggaaataatgtttcataagtagtttggatttgatttaggaattcaaataatgtaatctggatttattctctttcagacacatatgtgcatgggcacacccacacagacttacacacacttctgctttcttggttgttgacttcattctccagtagctcactccctctacgtagttgactccaaatttctaggcttacactctcatatcttagcaagtggtcctggtagaaaagtgatcatccctaattgaatagacataaaaatgtcccagacttgagaatcattccttaaagtcagctgctctctctgtgggcacagagatgaactggactggctctcatcataggtctgtgtttgtgtctggggtataggctccagggacatagatcagtcccgtgtctgggatataagttccagggatataggttggtccctcctgaaagtgaatgaaaatagagacagatggctcaccacatgaaatatcattgtgttaattccagatgaactgttaaaaactattaaaataagtaaatacagtcaatgttcacaactggtatgaaacatagtagtgaaaaaacataagggaaaattatatactgtaacatcacacttggcttatggtcttcattaatatctcttaacttcaacatgaacctcacacaatgatttagtgtcctcaactccaatgatctccattcattagaaaacagaagtcagtgtttgtggcttaaactacggtaggtactgaagacaagtcttggcatacatatgggatggaggtagcttagtgctgtaggtttgaaaccatgtggagctaaacagtctcaaaattccacacccacattgccaactctatctgcatataccttagtatgacaaattcaattattccaacagtaaactaattcagtatgtctcaagctgaactgattctttcctgccaaatcagttatcttctaactttctattaaactcctcatgattcttcattggaagcttccccataatgggttctacaacatattttgttttttaaaaattaatttaaattttgagtatataattaattcacttttaacagtaaaaggtttttctctcttctttatctgttagctccctgtatgatagtgtacacaaacactactataaatttcttataggttatctttttaaagatacatatgtatacacaaaaatgcatacttaggttagtctaaaataagttatgttccaggatctaccttatttttaaaaatacatattttttcaagagacagagactcactgtgttgcccaaatgaaatgcagtggctattcacaggcttgatcccactactgatcagcctgggtgtttggatctgctccacttctgacctaggctaattcacacccctaggcaagctggtggtcccccactccaagaggtcactatattgataccaaacttattgtggataacctaattagtatagcaaactgcagcccagagctctagggctcaaaaaatcctcccgccccagactcccaagtagcagggactctaagcacctgccacagtgcctggctgggctctactttttatccctttacaatatatcttatagcttgtttttatatcaatttaaaataaacaatctcattttaaaatggatgcctaatatgacctgatatccttgcatataatatatgtaccagtccttttttgatgagcataaatttccaactttttgctgttccaagcaatgctgcaataagtaacactgtacatatattacatatatattttattattgagttttaaaatctctttgtatataatggaaattaagctcttgtctataaattctaaagtttttttattcaagtatgtaatagccatgctcacagagaggaagaatcaacattgttaaaatggccatactgcccaaagcaatttatagattcaatgctattcctattaaattactgttgatattcttcatagaactagaaaacactattttaaaattcatgtggaacaacaacaacaaaatatccaaaaaaccaaggcaaccctaaacaaaaaacaaagctggaggcatcacagtacccgacttcaaactacagtaaccaaacagcatggtactggtacaaaaacaaacacatagaccaatggaacagaagagataacacagaaataaggccacacacctacagctatctgatcttcgacaaagctgtcaaaaacaagcaatggaagaaggattctcatttcaataaatggtgctgggataactgcctagccacatgcggaagatcgaaactgaccctttccttataccacatacaaaaattaactcaagatggattaaatacttaaatataaaacccaaaagtataaaaaccctggaatacaaccaaggcaataccattctggacataggaatgggcgaagatttcatgataaaaacaccaaaagcaattgcaacgaaagcaaaaattgacaaataggatctacttaaactaaggaacttctgcacagcaaaggaaactcttgacagagtgaacagataacttatatattgggagaaaatatttgcaaactgtgcatctgactaaagtttaatatccagcatcgataagaaacttaatgaaatttaccagaaaaaaataagcaaccccattgaaaagtgagcaaatgaaatgaagatgcttttcaaaacaagacatgtgtgtggccaaaaatcaaatgcaaaaaagctcaacatcactgatcattagagaaatgcaaatcgaaaccacagtaagataccatttcacaccagtaggaatggctattaataaaaagtcaaaaaagtaacagatgctggtaaggttgcagagaaaaaggaatgcttatacactgttggtgggattgtaaattagttcaaccattgtggaagacagtgtgatgattcctcaaaaacctaaaaacagaaataccattcaacctagcaatccccttactggatacatacccaaaagaatctaactcattctattgtaaagacacatgcacacttatgttcattgcagcactattcacaatagcaaagacatggaatcaacttaaatgcccatcaaggtacactggataaagaaaatgtggtatatatacaccatggaatactatgtagccataaaaaaaggacatcatgtcctttgcagaaatatggatggagctggaggcattacccttagcaaattaatacagaaaaagaaccaaatactgcatgttctcacttataagtgggagctaaatgatgagaacacgtggacacatggagtggaacaacacacactggcacctattggacattggagggtgggagaagggagagcatcaggaaaaataactaatgggcactaggcttaatacttgcatgatgaaataatctgtacaacaaacccccttgacacaagtttacctatataacaaacctaaacatgtacccctgaacttaaaataaaaattaaattaaaaaaataaaaactaaagtgtgtgggttctaaattcagaaaaatcatatttccgagttttggacctacatattgaagctgtgtgaaccaagactaacttccatgtaatgtgcaacttatgaaagtatctataggactctatttcctcatctatgtaatggggttagtaagactcagttgctatgagaaataaatgaggtgatgccttcaagccactgattattttcattgacataatatttgaatttgcatcattgggtagactgaacctcttttataacattggatatatactctgctttataagataacctcaccatgtaagataattgccatgcataatgttcaaaggatcaatatagaccactcacatggcttgaggatgaagacatgtcagcgtttgaaccaatttgttaagcaacaactactagaaaacagatgcctcaaaaaaatcccaattgaatattaagaattttgtcagtcttcaagaaaaaaaaaaggtactgtataccttcacagtcaaaatactggagatttaaggtgactggaatactgccaattcttttgtttgaaattgatttgccctttgaagtgttttggcagaattttggcctcattctcccttttcccaacaaatgcacctatccggctaccataaagaagttacagaaatgttttgctttatataatcaagggaactagctaaacttgaagaatctgcctgaaaacccataatccagggtgactatctctatgttttatcaaattggtttaaaaagtgcaggatctttacttctggtaacttcaggtgatgctctgtgcacatgctcactgccttatcttgagagaacaagaaccagggaataatgtttcctgatttcctgcttgaaatcccttaggtgaacattatctcccatctccctatttacttgtaaacaaagcataacaaaataaaatccagaagattgagagtgttggttctttcagaaacttcccttttggtgaaaatcattagtcagtgaaaaatagctcttcacctaggagacaaataaattagaaaaggccaatatgtttgtgagaatttcagggaaagtataaatggaagaaccagattcacaaggaaaaaatatttcttcaattcagagaggacactagaacaaaacaaaacaacttgatttaatacaatcagagggagaaaaacatttaaaatgtgttgtgtgtaggtatgtaatgccctaacggagacagatatttattacgtatcatttattcaaaattttagtgtgcctgtgtgttgttgtgtatttgttgtacaagtttctgagtaatacttccaccagtttcagttcagcaacctttggaatttgttgagaaaagccaggaactgtactgtagggtcagaatggctgacttctctccatgctttcactcgggtaacgaggcaagctgtcataactatggtttctggtgtacaggggaggttttgactccaatgtcataaatctcagcagtagaaataatcaaataggtaagttctttttgtagggcatgtcagtacatgtcctctgcccaatttctaaagtataatgtatctcttgggttttcaaagtcaggcacaaaatcctcagtttagaatgtacacagtgaccctcaccattactgaatgaattgcttcatgctgtactgtccagaaatatcagagagtaggtctctgtgtttaacaaacacagcactgactctgtttggttcttgcatttgactaggttagcagttgtcaactcggggtgaatttgcccccgcctccccaggggacatctggcaatgtctgatcatgtgtttaattatcacacctgtaacccagtgggtagaggccagggaccctcctccaccacccaaatgtcaatggtgccaaagttgagaaaccttgggttagtttttgggttgagcacaaattcagataaaaacataactcagctccttaaataaaaatttgataaaggaaatgtaacaatgaatatactgaaatttcattttgaagtccctgagattttgtcatataaaaacatgtgggcacagtttcttacccctttaattctaattctcttctgataagtggattttgccaagtgaaagaagactgaaacttatcttctctaggagaaaaaaataacttggttgtttgcattgcagtagctcaattatgaataatctataattttccaacccttgagaaatggcttttagctatttttcttttttttctctaagaaaatgtaagattaaaatggtttttacctatgcaggtataccttgccttaagcaagttctatatatacgaaaacacaaatttataaagaatattaatctgagccaagtgtttgctttagaaaaagaatttgttgctttaaaaaagacagtgtgggaagtttcctgcaaatttttaaatcatggcacatttacagatagtttgacccattttctgctttgggaaacacataaatattaattgaaaaattaaaaatataaaattagcgaatcaattagccatcttaaaaatatctgctaattttctaacagaaatcgcttcatttggctgagtaaatacaatagttgaagtgtaggctttacataagtattgtatctattaaacaggttccaataatgttcttttcttttctctacactgctatcattcttctgtgaagaatggtaccttaatcttatattgaggtaatcattcttatgtgaaaaactgccaaaattaagactttttgtttttcttatcagtctaagttttcaggggtgttaacacaactgaacaggcttacatctaatgcagtattgcatcatggatatgtcaaatacatattgaaaatcacaagaaaaaatagaataacagcattaaatataatccaacccaaatccctagcaactattttcaaaatttctgcaaaatgcacactttattcacttattcattcatcccttctagcaacaattatatatctagtacctgtgggattttagtacccaggagaggcactctagcacctgcatctttggttatggctattcagtttttaaaccacataggcaaggtccttccctaagtttacagtatagaggtaaagaggatgagtgaaactcagtctgctcagtggacagctgatgaagggcagggccatgaaactgtacagaagcagcaaaactagctttgtccagagagtcagggacaacctcttagagaaataacttaggaagaaaatcttttaggagatccaagaaaaagagatgacaaatgagaagataacctccttaagtgcccatggaaatttgaagttcacttcaaaccattcattacattgttatttaataaactcagatatagtggtgggagcatttatttgtaatagaatccaaaagctagactagaatatatagaagattttttttaataatcagtacctaaaagtgtatcagtgatataatctccagagtagattcaccctttttttttttttttttttttttttttttttttttttttttttttactgacaggagtctatctttgaccagggtatagattcaaagagtaaatccataatcgatgagctgcgtacccgtggagaattcatgagtctactctgagtctcagttttgtcattcttaaaataggcataatatctacctttagaattttgtcctgagaattcaaggtaactccataatttctagctcatggcaggtacacatcaagtggtagtttaatttttctcctaactaaaagaaattggtcatcaaatataaaaacatagttcccagacaaaaattactttttaaagataaatgataaatctacatatatataatacatatattatctgtgaaaagcattataaaataatttcttaatttcgtataagagaaataatttaaaaagaacatttgataagatggactggcaaacctgaaagagatttttattattggaatataaaaaaattatataaaattgttaaacatgacaaaaatggaagatgagtaataagcaaagactaaagtaatatgtacacaaaactgtatgatatggaagataatcaattcatatttaaactattacattttatagtaggctgaattatgagccccaaaaatatctctgtcctgattttcagaacctgtcaatatgtcaacttgtgcaataaaagggactttgcagatgtaattaagtaaaagatcttaagatgaggagattatcctaaactatctgggtgaacccaatgtaaccaagcgttaggatttttataagaaggtggtgggaagatgagacttagtaataggaggtgtcactttagaagcaagaggttagtgtgacgcaagaaagggcctgagagccagggaatggaggaagctggaaaaggcaagaacgtgaactctccctctgagcctccagtgcaatgtagcttggccaacacctagattttggacttctgactgccagatcggtagggtaataaatttttattagtttacccactacgtttgtggtaatttgttacagcagcaattaaaaaaaaactaatacaagtctaaacatgcccaggtgttcagaaaatcatgtgaaggaagacggctgacaatggctgacacaataaatgaattgaacagagaatgtcagaaaccaaaatgtattatagatgtatattttctgttgcaaaagtaagcaaaaacatatttatttatttatttatttatttatttttgagacggagtctcgctctgtcgcccaggctggagtgcggtggtgcgatctcggctcactgcaagctctgcctcctgggttcacgccattctcctgtctcagcctcccgagtagctggaactacaggtgcccgccaccgcacctggctaactttttgtatttttttagtagagacggggtttcactgtgttaaccaggatggtctcgatctcctgaccttgtgatccacccgcctcggcctcccaaagtgctgggattacaggcctgagccaccacgcccagccacaaaaactttttatatatttagaattacacagtttcgaaccatattaaatccattttatagcagtatgaaatgagacgaggataatgtgtattgaaataccctgcgacatttgtagaataatatggaagtagcctagagatacctcgttcctcagtgagatgcattgccatttttgtttattaacaaaatcctcctggtcaccatttcagctcacccagaagttaaactccttattctgtatgtttgttcatttgtaattaatgataagtgttttttagtgttagcgtcttcgtagttagcacgaaggagctttacagaagcctcaacttgtttctcgaattttagtaaagttgatttcaccatagagcaactcctctttgtgtatttacatatctctattactgtaattttaatttactgagcaagagtcaacatctatatcattatgtgtgattagacaaagaagatctattaacgttttcctaaacttatactgctttccccccatggttgaccctaccatatgaaaaagagactcgtggttgaaatggtacgttggatgaaaacaatgaatgacaataaagttggagagaggggagaaacagctgctggaaaatctctcttatccaatgtccagaatgctgattgttttggggaggaagtaaatttgtattggcttaggggaaatcagtttgtggacaatactggtttggggaaactttgttacatttctaatttcctgacctgggtcgttacaatcaaacaaaattttattcttttcacttgcactccagatggaagaaaatgtaaacagctgtccaagcggtgatggagccttttcttccacattcttgcatgtcattatgttagagatttactttttcagcaaattgaaacctctaaaccaagcaatcaaatttttccccctctccctctctttgtattccaactgtcatcaattgcttactttcagaaatagttttctaaagatgaagctctgttgaatatgcatggtcattatcatatttactctcatcagtaccatatagcattatgttgtttacaataattagctgctggaggcaatcctgtaaacacagccatgtgacagcccaaatggagagaatcaagtcattgttaagaaagagaataggtatgcgccggttggactcctatgctgtggttattggtggtgattgcaatgtatgggtccagtccaaaaagaaatctcttactcaatacttctctagttgctgggcacatatgaaagaaatgaagacatgagggaattcagatggttaaataaagctaacaagacagatttttctttttaaaattttgtttaagtctgtgggctaaccatattcacttaggaagcaatacatacagtaaaaatgcaaaattaatatatttaacttaaacaaatttagatttatgcatagggtatgcccctatttagggtacacccctattactcatattaagcagacagttgatgcaatcacacagaaaacaatcaatgcaagctatcaaaatctatgaaagtatgtataaagtttatttcagggtttcctgaccattagaaagaattaaaattcactgtttaagcgagcctcaagtagatagtgataaaattatcactattctcagggaagaaattgaagaaaattgagggcaataaagaaatattactaatatagaattagaggagcagatatatatgtgtgtgtgtatatatatatatatatatatatatatacacacacacacacacacaaagctttatgtgttacttaatgggagttttataagcttttcaaggattattttaattttatggaattgctgctttccttgaactgcctcgaaaaatgttactccacaatctattaactaattcaacacacatttattgagtacctcctagattgaaggcactactccatggagaaaacatgaataatcagacacttttgcttttaggagctgacagtctcaatggtactgatacatcaaagtaaaatgtgatgcaatttcatagcagaatcaacagtgtgctaaccaagcatgaagaagtatggaaagtgatgtgagaggaaaaactctttataatttgttcattaaaatatattgcagttttagagttccattgtgtttaccaaattatcaagagaatacagaaaattccaataaatagagaagaagtgggtaaaatgtaggtctttactagcttattttaagatagagtaaatgtatattagtgcatatacttttgtgttttgctttttcttttagtgagagagggcataattttcaaagctgtgttgtggctagatagggaatacacaatttagatagtgaaacaatcaagcccattctaagtgccaaaagtttaatcccttaatgagaatctaaaaaagttttttttttaagtgtctctgagaaatactaatggtaactttaaaaatgtatatatttatatgcttacttttattagcgattcttagtaagctcccccataccaataatctcatattactgagcaatcactccatgtagttagagcaaaagtcttctgctgttgtacggaaaaattgatctttaggctgtgtagtggatgttgttgttgattggcacagatcttttctgggtctgcacttgtccatcaactgctgtgagtattatctcaatggttgtcttttctcggccaagccagagcccctacggctaggaaggtatgctgctctctacctaccctcttccaaagcccagagccaagactgactgtttttcttgccataaaatggaatcaactttctggcactatccatactctggagcttcccactggacaggctgaagttaggttatagctacttagctttttccccctggcttatcctgctttttttactccccttatccagagagcacgtgtccagtacattactggaaaaaagaattctcatctcagactctcttctagggagcctgaactaagttaatatccctacattcccagtacctaacccagtgcctgacatatgtcaaattcagttagtgataattgaatgaatgctgaatgacgtttgcattcatggtattagccatttggcaatactcaggactctcagtttattgcaggatgtatgtcttgatagacctctctacactacaacattcaaaagggaaatcattttagtgaccacttacagattcatgaagtacaacattgaaaatccactgacatttttgttctttgctttttttttctggttcctctctacttaaggaagtcaattttagaggtgatccacttatctgatactagattcagccaagttgcagaagcaacaaccaacacaactaagaacaaataaaatgaaaataaaaataaaaaaatctggagtttaaaaaccaagcgtgttgtagtcaataaagtgttaaaattttttaaaagttttcaaaaatacatgctgtaaataaactgaggatagactagctgcacagcctcaataaaaatattgaagacattatgaaatggtacacttgcatgatgatttataatttacacatgggtattaatttgaaactaccccaaaaaatacagcctacttacatagcttcagaatttaacccttctcccatttttcccccaaaagtgtccaattatctcctgtcagacctgacagtgagttatcttgttaaagagcttgcaattccattatagacaagctccaaatattgatttgtgccttttatttccttggtctttgacatcattgtaggactaaaaatgttcaaatctgttgctgcatgacagaaagaaaatggtcaagagatctcagatacatcaaaaaatagtttactgaatttatacttcacaagacactgtttttgtagtgtaggcctacgtgggtccaaaggagaaccaagtacaaaagtgtgagcagggaacagctttggaacacactcagtaaaggtacctggaaggggcttgtcagggaagcctccatggagtggcctcagagaggcacactgacatcatggcagccaacagagaaggaaatattgtcttaaacagaattcacaatgcctattttgtaggcatgcaaattattaaatatttaatgtgagctcttggggtaaagcaaacaaatatataaacaaaaactctttgtctctttaccctttgaaatctatgtcaccataaatagctagaaaaatgctcattgaacaaataaatgaatgagtgaatgaatgaacgataaattcagaataattactttgtatttatttggcactagatgagggaataaaatatgttccttgaactccagttttcataatcagtttgttcacctgtaattgatgattttcacttgattttaggaatttttggtgtgataataggtggatttgaaaatgtcaggttttatcattaaataaatagtattctaatagagaaagtagaaattgaataattatctaataaattccaacagtgagaactactaagttggataaccaccctgaagtaatttgtatttttctttcagagtaaattcttttaacatatgtttaatttctttaaatgactccactcaacctaagataataagaatagcagtggctttttagagcattcagatttcaaatacattttctggtaataatgtttctaccaaataaaagaggattaactctgtagagtattttaaagttgtgttcttaccgtataatcacatagacatttatagttaatgctacatttcttccatttgcagatttaactaacactttcatgaacattgttccattttttttgttccagtagtttatctttacaataaacaggtaactataagcaaagtgctatcctgagttctgtgaatccttctagaaaattatggaatctgagacaatgtaatgggaacccccagatttatagcctgtgggtcaggacccaatgggaattggttactgacatattaagtgagagcagtcttgtgggactgagaccttaacctgtgggcctgtgctatctaaagacagtgtcagaatggaattgaattattggatattcaggtagtgtcagagagctggagaagacacagcatatttgatgtcaggaggaaaagatccttttatcaactgagtcaaattttgagctacactataaaagaaaaatgtcgaaattgaaaaaattttaaatacaattaaatgtgtacagatagacacaaaaacactgagtggaataacttggagataaatttgaaaaaatatcccttaattaagataaaaaacagtcaaggagagacagagagtaagaaaagatataacaaatttcattggatcaatccgatgaattaaacacaaatttattataatcttttagagacaaaaagcagactaagagtgggggaaggtgtcatcaaataaaaaaaattaccagcacttgaaagacacaaatgtgtgtaggaatacagagaatctaaactgataagtgagaggaatttttaaaaataacatacctaaacataccatcataagatctcaaaacaccaacagaatgtgctaaaacttccagaaaaaagaaatctacaaaatattgagaatcaggctggcatcacatatcacatcattaaaactagtctctaggaaataatgctttcaaagtttgtcaggaaattattttgactataaatcctatttcagtcaaataaccaatgccaaaataaatatttttcagacaagaagactcacgggatatttgcaggtatgtgccagaaaaacttagagtgaaaaccaagagaaaggaagatttgagatacaagaaacaatgacaataacttagaagtgcaatgaaaataagcctcaggatgatgcccaaaaagggaccaatttagaaaaggaaattctaagaatctaagttgaatgtcttcagaaaatgaaatggagtcaattagaagtaataatgaataataaattagaaaatgctaattaatatttgaaaaatattttccttctctggacaagaaaaatataaaataaatgagaaaattacaaaaatacaaggcatccaagtttcaaataaaaagtaaaataaaatgtactatgatcctaagcaactgatgagttcagaaaataaacaatttatctggacgtgactcaagaaatagtttttattaaatgtcttagaagtagtggacactgaaaccacaggaaagaaaagtgaatccaaaatagtttaaatgttgctaatggttttcagtatttcaaatcaattggtagaaaa

SEQ ID NO: 831 - DNA, 2733 bp, Homo sapiens
ttttgcaattgctacactctccattttggcattgaacttgattaagactcttttcagcatccaagatcgatctggagtttggagttagtttttatttatgcgaactccaagctttagaaatattgccaggcctgctggaagctagtgtgaagttaaagcagcaagttccagttgtggctgcaactgtgctttctcagaatggctgtttgttgctgggcattggatcttagcctcccatcgaggcctgggtctgaagctaattttactcagcttaggtgaaaacaccaccaggggtgggtggcccagaaagaaagaggaacctttctattcttgatctatttattttgtggccaactgggcataattgactaaagataattgaatccacctgataggtgttaagccctctaggtgttgagtttttgttcgggagttttgttttttttttaattcctctagcctctttcttcctttctacctctttgcttttcagctttattcctcaggctttagagccagaaagaacaaaattcagattcctggctttgccacttggtagctgtggacccttgggcaagccatgtcactttcctgagcctcctatgttcctatttggagatctgtgccacaagatggtagtgaggccaaaatgagatgcaatgtatgaaaacacccaggagccctgaacacaggcatggaattcagtaaattttagtgctctcctccctccattctctggggtatcattttccacattattcaaggacatgccttcctgcctggcttctaggattaggagggaacatttgtttatttgaaagggaaaaggaagagaagtaagtgctttagcagggggacgtagaacaggcagaaacaatggctgggaaaggtgctcagcgagtttgaggaagggaaaggccagtttacctgcgagacagcgagtaaaggggcacagcggagaaggcaggaatgcaggggccattggaaatgcctggaccttcaacccggggccctgggaggccgttgaacgctgaggtgtgatatgagtagatttggttgctgcatggagaatagactggaggtgatacgagtggctctgggaataggatttgagtcgtttggtcttaaatcagaagacagcctaatccagggattcccatacctggccttccatcagaatcacctaaggagccatttcaaaatacccatttcccagcccatcccagagccactgagcgaaaacctccagggacattaggcatttgagaaccactgcttctgtccatgaaaacatggcttcttgatagcatcacctgggacaaagtacttaagtccttaaggtagcacaccaaatcctgctttttgaattttgtgcttccaccaacactagttgtgtttctaaaagacccttggcaccttgttcccagtgcacatctgcagccccaacaggtgttcctgcctgagagcctttggaagctaattagacacgcacaggtgtgcctaatgaattcctgccggaccacacgctgtccagctgggaacagcccgggagcgaggccaaacaaccatataaagcgaggccaaacgacctattctgatgctttttgcatgctgtctgccgtgttttcattccccacggtgaggacggtgtgtcctgtctcctaaggccctgtgagccaagctcagctacaacctggtgccccacatctgacaacagggatttccactcaaagtgcttggcccttttgggcctgggggtgatgagtgggactggagccaagaaaccacaggtaattgggattcttctaggctctgtgattcccaggtgggttttttaatattcagggagtagcaaagatacaaatattgtagagctagtttaggcgtacaattttttttttctagacgtttctatggaacactaatgttggtgattattttgcagggagagggaatggaggtaacagggacttagggttttcatttcgtacttttctgcagtgttttgaaaaattaagattataagccttttttaaaatcacctttttcaagacataactgatatatagtaaaatgaacccattttagtatgatttgacaagtgtatacactcacataactatcacttccacaaatgagatacagaatttttctgtcaccccaaaaagctcctttgtgccttctcccagttcatctccccaccctcagccccaggcaaccaccaacccaatttctatatggaccatttttattttttctgtatattttactgtactaagggaaaaaaaatgtaatggaaatcttaaaatgttcagagggaggcaaggtttggtcactctgaggaatccctcttactagctacaaagttggtaggtaagggctgggtgtgtgtgtgtgtgcgcgcgtgtgcgtgtgtgtgcgtgcgtgcgtgtgcgtgtgtgtgtgtgaaatcggccatgttttccccttgtggggagaggggagaatgagaaaacaatattcaggtgaggctgtttaaaagaaagttaaatgtttagataattttttaaaaaataggaaaatggaagtaaatatgtcatgggagtatgggttattgttttgtttgttttgtcatgtgtttatcgtttttattacagaaagagttaactttttttttgaaaagctgtttaatgcttaccctactataaggagaaactgacaacaaataggagaacaagagttgagagtaagctg

SEQ ID NO: 832 - DNA, 39939 bp, Homo sapiens
tccacatcgcagttgggtgagtgctcaaagatgtgggatcaaaatccacaggcagctcccccgctgtcagaacaaagcccaaagtctccccctggactgtgaggtccccccaccctctcacctcagctcatgctgcccctgcctcccacaggcctgcctcaatacccccactgccagcaccacagctccccaggcctagaaagtcaccttctttcttatggctggaatttcagttccagggtcacctgctgagtccccctcccatgagcatcttgggtaacatatgacctcttctatcacgtgaccctgctttattttcttcaaagcatttctaactacctgcaatttcctgtttgaggtctaaactgccctctccaacatataagcttcattcaaacaatatttactgagcagctgccaggcaccatttctgatgctaggacgtggtgtgacagagtaaataaaagctcttatttcctggggctgaacttctaggccatgagttggggggtggggggtgatggtgccaggcaccaatacagaccatgataaaacagagccaggcaagggtacctctgcgatttgaagggcagggtggcctctgtccatgctcaggatggtgcccagacccctgcacagagcctggcacctgctcagcacctgatgaacagcagtgctcgcatgtttggaggagaggacctgagcccagcattgttttcgcatttcctggcatttcctcatttatttttgagacagggtcttgctctgtcacacgagctggagtgcagctccctccagcatgatttcagctcactgcaacctccgcctcttgggttcaattgatcctcccacctcagccttcccagtagctgggattacaggcgtccagcaccatgcccagctcatttttgtatttttagtagagatggggtttcacctgcctcgggcctcccaaagtgctgggattataggcccggcatctactcatttaatattcactgagcaacccctgaagcaagaattgtagccactcacgctctaccgatgaacagcacactgaggcccagacagatcctaagacccggtccctcccctgccatcactgtcagctgacccaacgccccactgcctgctgggtcacatgcccagatgtcggcatttaatggcagaaatcaacacacactccttggctgacagtgttctaccatgcccaggtgatctgtcacccatgcggggcatgatctgggctcattgcaacctctgcctcccaagttcaagcgattctcatgcctcagcttcccgagtagctgggattacaggcatgtatcaccacgcccgactaacttttgtatttttagtagaggtgggatttcaccatgttggccaggatgttcttgaactcctgatgtcaagtgatccacctgcctctgcttcccaaagtgctgggattacaggtgtgaaccaccgtgcccggcccggtcatgcttattcttaagcatagagcagcagtgtgggggaacagctgctcctaggtgttcactctgtatcctccagggactgcccattggcacccacgctgccctgtaccttctcgggtattcctgagagcaaattattcctgagaagcagctctggttccaactgtttcacatctgaggagacagcgagtgagggctatgcatggctggggagagaccttaacaggggatgcctccacagctcccctgctctgtaccctaacctcccgagtccttcctacaccttctgccccgtctcaccttcagggcacaggaagggtcagcagccacagctgtggaccacccaccaccagggccccaccaagccacagcagagactggagttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctctttctaggacaaagtcccccaagtagggactgcaggatgagcactagctatacctccagccgagatgtggcagcccagtgctgagtgttctaccagtccaggtcccaggctgctccctcccccacccagtccctctccagtccccaggtcctcctccagctgccccgggagcccactgctggctgagagcacactcagggaaggggtccagcaaaccaggggtccagctcctcaagcaactcctttcccaagcctcaggcctcagatgagaccctcccctctaagggaaggaaagtgttggagccaagcttgcccctgggcctccagccccagggtccaggttgtagacggctcaggcctgttatggggaagccaaggactggctctcacctgagaaggagcttgctcttggagtggcaatctctcacctagagggagaggctcccacatggaaagggaagtacccacttgaagtgggggaaagagctcacctgggaatagaagctttcaaggggaatctcacctagagggatctctgacctaccagggaatctttatcagcctggcaagttctgatacagggggaatcttccctctgcccagaggcacctacttgaagtcagagaaagatctcacatgggaagaaaagacctagagggagagggttctcacctggggggtactctcccatagagaaagctctgacctcgggcgaggctcccacgtggaatggggaaaagctgtcacctgggaatagatctcacagaaggatcttacctgggggaaaactctagcctgttggggaagctttcaccagtcaggaaagttctgatctaggaaaagccctgacctggggagaggatcccatttgagggacaggaactcacctgggaagcgcctctaacctggctgtactgttggaggagtgtggagtgggtgcaaggaagatcctcagagactcttgggaccgctatctcaaggagatcgtagagccccctctcctttcctacgtgagtcactcaggtcttcttaaagggctccctcccccgacaacttgggacccgcgtttggagggcggagccttgatcattggcccctccctgtaggaaggcaactggggccagaaaggccggagcgctcactccgggatcagtggagctgggtggactcgggactcagctgaaagcagctagtccacgggccgctgccagggactcccgtgccccacgcacccccgccggcacatctcctggccgggctcctccgcacgcagctgcctccctgtggcccgggatggccctcgggcgtcacaccagcggctttccgcacagcccaagggactggggtcgcgccggctcccgcccccaccccttgctgcagaggggcagccgcctgcagaaaatcagcagaggtaaaccgaggcgtcgcaagcggagaatgcctgctccagcgaggcgtcgcaagcggagaatgcctgctccagcgaggcgctcgcgcggggccaccgggaatgtgcgctgaactcaccccgacgcatccgccagccccatggctcgcaagttgtccggtgcgggctgctcctgctgctcgagctagaggccgctacgctccggaaggcggcgccgggaccgggtgaggccagctgcgctctcccgggggctaatcccggggcaggacggggaggcttgggccaatcagcgcgctggggcggggcctaagtggcgcgcgccgggcggggagagactggagaaggaggatttaaccgcttcctccccggcgacctggcctatgaggcctctcgctgctcgcccggccctctgcccggagctggatgggactgcagaactggaactaagcacccgcgccgggctggccgcagtcgcgcccccaggccctgagtaggttggagctgatcccaggtcctggctcggcggaaggtgctcacggagtgggaaaaggaaactccactggccggtgaccccagccttaactcgtaggggatccaggtctgtggggcctctcttgccttcagctgagagcgccacccgcaggctttctgcgactacgcatctctttgagacccggagccaacggtccccaagtcctcccctttaactctggccacccaggccagaaatggttggaggatcccctccgctgcactaagcacagcccggacgtagctcccagaaggttactgcgcgggccgccgaggagaatggtgggggtcagtgctgttgggtgggcgtcagtgctgttgggtgggcaaggcaggaactgcaagagcagttcctcaggttggtttcaccgcaggtgagggcaaaaaatgccgggtcagggctgcagaccctgaagaattaggaagtcctgttgccgttgccttgaccagcggggaggttttccttagcaccttattttcagcacctgtgctccaacatcaggccccaattacaaagtgaggggccagatttcaaggtgaaagagatctgccatgaaatgggctaaaaatagctggatattcttgggaggggctcagattcctcccaaaggtcagtctggcttgaatcattcacagcttccatcctacctccccagcccccaacaggaaaaggcaacaactgttttctatagaagtttattcccaaaacagagcgcggcttcacggaacaatttacacagacaggaaagagggccgctgggctggaggaggggaaccccagagaggggcatctacgaaacctaggacatagtaaagacaccctcccacccccagcaggccactcagcccttcaagagctggggtccttctcggtaaggagagtttgggtcctggctggtgggatttagctccagtcagggaagtagaatttctaatctcccaggaagctgcttcccaagagtatgcatggggtggtgggtgaggaggtgtctgcacagaccaccccccagccctgcacagccactctcccccgtggttagaggacgcctactctcaaggtcttctggatctgctgttaaacgggactcaaggctgaccttcggcctgggagacctgggggttagaaaacccctcaagatggccaggtcagggtcctcacaggtgggtcctccaagtccctctcccactttccctacctttcacttggaaacaaaggaaaaaaaattatctactgtaaacaaagtgtaaaactcaaagttttgagttgtaaacaaagtaaaaacattttttgaatctggacttgtaaacagtaacaaaattttaaagtcttcagttctggacagcagacaaaatagcaaaagtaagagttttgtgaacagggtcgtaacagtcatttttccctttttaagggaataaaggaggagtggaacggagtcacttcctgcagcccaggtgcctagggccacggaggatcctgtaaacataggaggcagtggcacctacattctgggtcttgaattcccttgtttctgctccctttgctcaccttcccaccctacccttcggaatcaattcaagcagggggcagtgtcagggaatcaaatggcaccacagacaacttttgcttgctgcaggggcaggtgaatgacccctccaccgaccctctgcaggaatgtctgactagaggcccgagcccctccccgtgggagacagggaagccttgctctgtaaacacgacatcagctgctccaccagcaccccacagcatcagtcctaggtcataaggcagtaagtggcagggactccacataataaacacacacatccaccaggaggggcggtatgagcaagcccccatgaggaagtcagaggacccctgtttccaagaccaacccccagccccagaagtttggcctttggagcattcaataaaaagcaaagaacaattctgtactttgggcccctgacgatactcagatcaacttgggggtggaatagggggaggaaggcatgtgtcccacccatctgagtccaccccaggaaggagagagagatgagcatagggtttgctcaggacccaaatggggtcaaactgcatctctccctctatctccctccccctcccagcccagcctcaaaccccccaggagacagaaaagctgaaaaataacataagcatctctctggttacaaaggtacaaaacgtataaaagtctccctccagtcccccgtctctgcacctgtcacacgcatgctcacagatgcacatggagcctcagccctgccacaccaggtagagctggggcacccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctccttgtcctatatgaccccctaggcgaaccttcccaagcaaggcctcctgctctcctccctgccccttgcatattccaggtcatctcccacttctaggcctcagctcctgccctcccattcgctagctcagcccatcggatggcacctatttctccttagcctgggaggtgctgggaaggctggctggctccagtcacacagccagcaagtccctgctagtcacacccccatttcttgccagattcctgtccccagcctgtggccctctggctgtgctgagcctggggtagcccacacctgtctgccagccctcatccccttctgtggcagaacacagggcagggcacacaggaggttgccctaagctgatgagggtgcaagcaggtggctggaccatacttactctgagtctggcgacagctccgagatgctgtgagacgtggcagaacgtggcgtggagggcccaagcacagaggctgtggcagaaggtgtggcagtggtgtgagggcccaagggtgtgcttgaagattgcacagaggagagggccgaggagttgaaagaggcaaggatggaggaaagaatgtccaactgttctgtggaggggccatggctggggccactgaccgagtcctccctagctctgagcagctgcgggagtggcccaagggcttctcgtgaggggtgccggctaggcacctggtccagctgctcccgagagttcgagctcctagacagagagtccagcggccgggatggcaagagggggtcccttgagagttgccgctggggagacaggggcagaggtgggggctgtgggtcaaggtcccgggtgcggcggggcggaggcagcgtgctcaaccactctcgaggtgcccctaagtcgagcgcatcccgtgacccgaagcggccagccatggcgccagggtagtcccgaggtggctgcctccgtggcagggtgctgccccgatctttgggctccagtcggcctggtgcagcatccatgcattcctgggaccctggccggctcaggggacgtagaacaggggcaggggcttcctctagtcgctcacggctcagttgccgccggaggagcaggtccagctgttctctagaagagtagcggctggctggctgtgaaaggctgcccgtgcccccgccagcatagatgcgaccgtaagaggcagctggcacagcacggtggcccaaggtggctgcacggcaccaggacagctcaggggcacctcgggtctgtggcaccagtgggtattgcaaccggttcttcaggatgcctgtgagaggaagaaaatggggggcagggtttgtgtgggagggggagggcaggcaggaattgctgagtctaggggtgtggcagcccttgggatccttccaacacagggatgggagcaggaaccccttggggagcagcagaggcaaccctggtggtcccagagaggcagcaggacaggggtcagagtggaagggcagtcatcttccagttgtggtcccggggcagggggagggcgggcaggtctcatggtgcaggggatggggcaaactccctgaggtcagaagaggggcagccctcaggtcctgacaatgcaggcctggctgaaatgcaggaaccccccgggttggacaggagcagtccccaggtccctgtgatgcaagggtgagggcagaaacctcttctccgggtccccataaaagcagagtagggggcagaaatcttccagatcagagcacgggctctgggatctgggtggggggcagggggaagcagctcctagggtctctgaaaaacagatgggctggggcaggagtggtcgcctgtggtccccctgtggtgctggccagggtagagggggacagagaattcccaggtcaggacaggagcagtccctgaggaccgtgaagcaggctagagaagcagaagcgccctaggtcagagtaagaagagctctcagtttgggatgaggaagctgcaatcccttggctcagggcatgagcagcccccagcgtgtctgcggtgtgggccagggctcagggactgtacctttcctctggcgctgggcccggcccagagaagtctcatccccactggtcagggccgggtctggctggttgttgttagctgcatccttgctggtgtccagccccaggcgcctttcagagccccaagtctgcagagcacagggggctgcctcgcactcccccagggctggccagtaggacaggaggtcattgccatccacatctgtggagccaggtcaggttacaggagcttctgggttgatcccagtgactcatgacccctgaccctaatgacccttgaaaccctggctgttctcattgagcagaggtgggaacaggagggtatctcctcagagatcaatgggtgggggtgactggtgagctccctccccttaactggaggtggacagagactaaaagttggggaacctgatgactgaggggtcagaaagaccaggatgaaccccaaccgcaggaaagatggggagctggagggataacaaatggggcatcccttggtcacccaaggggtcagagggcgcctggcacctttggggtgggtgaggagcctctcactctgggctgctcggcagagtggccgttggaagcgcccccgcgtccggccattgtcctcgctttctgaagatggaatggagagactcctctcctcctccaaggacaggtcactgtcagagtcggagtctgcgcctggagttgggaaagtcagaagtactttcagaggtaagggacttggagataagggaatttggagttgagggtctagaggtgggtacggcaagggggttagggttggggacaggaaccggggcttgaagtggaggtagcagcagaagggctgggacttatcagagggaaggacgaatcaggagtggactgggagaaccagggctggagaggtaggtgcctcctgaggcagggaccctgggggagatcgtcccaccccagtcagccactgctcccagtatggggtagaagaaaaggggatggggagagatcctctgcctccctcctccctgccccaggccccaactccaccagcatctcgatggaacatggccacgtccaggtcagtggggccagcatgagcctggaggctgtggtcagtgtggtcagcggctgagccatgtcgaaccaggacattgtccctggaaaagcaggagcccccccaccatgaaagagggatgtgatggggtgccttggaggctggagtgtctttgagtgcacagccagctgcgggtggaatggcatccctgggtgtgtgtggtgggaagcatttagggcagaggcagaagcagggccccagatggccaagatgggtggagccacccgccctaggacctggtcagccaagccctggtaaggtggggctggactaagctgagtgttccctcacaaggaggctcttcctctcacctgaggtagctgcggccccgctggctgtcctggtcctgggtccggccggagcgggcactgctcacagaggagacggtggaggcgcccagagtgatgcggatgaggccactctcctcaaagagagccgtgttgttgtaggccccaggtccctgggggtggtagggacagagtgtgagctaaccctgaagcagcctaaaactctggcttctcagggcccccatcccgactcaccagcccaggtgctggccttgcctcctcaggcgctgccttcctgcccagacaggctggcatccaggcagcccgagcatctgcatttaggacacagaagagcagcagcaccgccaggccctgtgggtcagcgagggtcaaagcagagtcggcagggatcaatcagggaccagtataagtcactgtgggtcagcaatggggtcagtcactgtaggctagtgtgggtcagtgaggagcccatgcgggactcagtaagggagttggggaaggtcagcaggggagaggatggagcagcaggagtggctggagtctgtaaggtcggtgtggatcagcaaggggtcgggagccttggtgttggtgaaggtcgatccaagatcagcactcagtctgggatcagtgcctaagttagagtcagctccaggcctgggggcagcagctagggccagtgtctggtctggggtagtacccagcctggcaaagttatccagtaagagtcagctccaggcctagggtcaacgtctgcctagggatggccccagcctactgaaggcccacctggttctggggcaagggaggggcaccagagtcacctggaggccgcagagtccagcatggaggtagtggaaggctaggatgctgtggttgactgccaggagcccaaagagccaggaggcactgaccagcagaagcagcaggaaggagctgcgaagggtcctgctgtggggacatgggaagacacaggaggacatgcaaggctcatgtaggactcatgcagggaacacgggaggacacacaggggccacacacgaaacgtgaaaaaaaggaactcacacgggaacatggaggtctctggaggacactgggggagatgggaggtcccacaaagaaacaggagagcagtcaaagagccatgaggacacgtggggaaaacacaggggtatgggagccacaagggagggcacggaagacaggtgggaacacacagggcagggggcaaagtgagccacccaggccatgggagactctggggggacccagaggacaaggagagacagcagggcagaagcacatgtggggctacagtatagcgagggcgccagagagggaccacaggtcagggcaggtgtgacttcattccttcatctagaacttggagcccaacctgcaccagggaagatctgggggccccagaccccacccaggagggacctgccatcctgagaagcccccttcctccagccagccaactcacagtgcagaggtcttcttggcctccctctgccctgtggagcaggatgtgcgggcagcgaggagaaacatggtcccgttcatctggacccacggccagacatgtggggccgggcagggcagagagagagagagagagagaggcaatgagagacagagagagactaagattcacggagagaggcagaaccagtgagaaattcacacatatacacacacaccaaaggagcttagcatcacagaaaaagaaattgggaaccagagagggactgagagagagaagcagagacagaggcagggacaggcaactgaatctctgaccccgcgcccccatctccatgccagttgaatgggggtggctactgaccagaggacagaaaaaatgaaggccgagcccaggaagcctgcagaatgccacctgaccgccctcagctgagtccactgcacctcctcccccaatgagggagggaagtacagagggggcaccaagtccagggcactcaccactatgaccaggacaacagggccagcaaagctccagatgaggggctcgtggactgagatccagcagaagtcagggttcccatagccctcagggtccaggcccacagcaaggccttgggaagagaaagggtaggactgagggtgtgtgttccagagctgctgaccagcccatgtatgggagaaagcatgggtgagggcagagcagcaaccccatgaatagatggcttggggtttgaggttgggggtcatgagcaggagtggggacagggtcaggggtcaggccatgtgatggttggaggttgggggtcacagccctcacccagcagcacagcagggacgccccagcccagggcatggtagaagcgcatggcgccgcggtccacgttgcgtggctcaacctgcatgcggtagaggtgcagcccctgcacgaagagccacgcgaaggtgctgaggaagaagtagtgcaggaggatggcgactgcagtgcacaccagctgagggcaggggggcgtgtcaggacctctcctgcctcacccacctctgacccctaccccaggcatctgcttcccacctctcacccctaaaccacaatatcttaccccagcatcctgctgaaaaccctggccccaacctgagcatccctgacctctgaccctgagttttggccccaggcctcctgggccagtagggtcatcaggacacaagttccctggccctgatcctgcacctgattgtgggtcctgtgaatccccagcaggaagaggagctctgccacccccagggcggctgccacattggcatggatcccacgcacattggacttgaggctgcgcaggctcagcaggatggctgcagtcagcaccagcgcagccacagacacagccacgaccacgtgggtgaacacagccagcagctccaggtcgccctccagcctctacagagacagggatggttgatgggttgttgggcagaatccccgtgtccctttgaccccccacttccttgggacactgaacacagccccacctcacggggagaggcatccatgaggaccccaaaggtccctgtccggctgcagcgacaccgtgcgtgggacccattcctgtgcaccagctcgcagtcccgtgctgtccacacaccatgctgctccgccctgcagccacagggcagttagacacaactgtgacccagtgtcaggcaggggtttgtgagagatcatgggaagggctgagggtgcctggagttggggtacagcattcctcatggtccgggttgcacaacagcactagtgggggccccaggggaaggctgggactattagttggcctcccaagggctaacgggaccaagggtttccagaatgggggtcctcacaggccaggtgggtcccactgcacacagatcgccttgctccgattcgctgtctgtagcaggcgaaactctaggctgatgggggactccaggattccccttaggaagttgcgtccgtggaacacagccacgctgaccaccggggagttcatgacggggttctgaggaagcctggggagacacccatctgggcttacgcactgctgacctccccatgctcagcctgcttgcctcaccccgtcttcatgccactcgccagggctgacccagggtctgggatgtccccagagtggaagctgtttctaagaatccctccagcttctgctgggctgctgaggggctgagcagctccaggggacctgcaactgtttgcctctgattgccctccctcctacccccatcagtcagcctgtccttgtctgtctctgtcagccctttggtctgtctgtacctggctcatggatccctcctgtgtgtggctctgtgtctgtcagcctgtggctctgtcactctgcacaactccagagaataagattcacacagaacccggcaaggatggggctccctggagctgtgctcctctctgtgtgttgtgaacctacgcatctacccaccaaaaaaggggctgccaggctgagaagttcgtaggaagctcaggggtgaggggcctgagtacctggcacctcggcgttctgcctggaactgggcagggagcagtccccctaaggtgcggtaaacgaggagaatgataatggagatcccaggctctggctctggcggggctggtggggggaccacacttgaggtggtggagttttctatgctgctgcttgtgggcagaactgccaggagagaaggaggagcttctgtcagtgacctttgacccaaagcacccaccaacccagctctgaacccgatcaagcatgggggtctcttccctgcaggagcagaattggggagtgcagggagcatgaacccagaaagtaacagtcaaggcctgggaggggtcatttgtgatgagggagaggctctgacaaagtgaaggtgtggcaaggtggacagtggaggggagatgtgggagggagggtggaggggagatgtgggagggtggaggggagatgtgggagggtggagggtggaggggagatgtgggagggtggagggtggaggggagatgtgggagggtcgagggtggagggtggaggggagatgtgggagggagggtggagggtggaggggagatgtgagaggcagggtggtgggtggaggggagatgtgggagggtggagggtggaagggagatgtgggagggagggtggaagggagatgtgggagggagggtggaggggagatgtgggagggtggagggtggaggggagatgtgggagggtggagggtggaggggagatgtgggagggagggtggaggggagatgtgggagggagggtggaggggagatgtgggagggagggtggaggggagatgtgggagggtggagggtggaggggagatgtgggagggagggtggaggggagatgtgggagggagggtggaggggagatgtgggagggtggaggggagatgtgggagggagggtggaggggaaatatgggagggagggtggaggggagatgtgggagggtctgacactggggaggtctagaaaggggaaaattggcaggagggcaacatagtatctggttggggggacagagagacaggacttggcccaggggtcccctaggggctctcaccttcagatggggatggccgtggggactgggaaggcagcagcacatgggtgtgaggatcccaggcatcctggcctcgaaagaggttgctatggtagcgagggtagcgacgggccccccggggagaactggggtgctccatgcggtcaatgctgagcactacccaggagaaagaaaggggaggcccatcatggacctcttccccctgccaagggttctactccctcttactcgcatcccgcacctgagtcccacaatctgttttctgtgctaccagctcggagcctgtccctacaaaacgctgagggcggtggctgagtctcctgccattaacattggcattgatagccacagcccctcagaccttcaggtacctgccctttcatggcccccctgctgtgccccgccctaccccacccacaacgcactgatattaggcgtcaccagccccatgggattcaggtatgtgagttccatattccttgcgagtgtggctgcatactcctccaggtgcctcaccagtcccgcgctgcctggggagcccccaggggcccgctgccccagcgccgcccacaagtcccctgtctctggggcaagcagtgcagagccggcccacagcagattctgggaagacagagatagaattgggttcagccaggtggtgaggatgtatgaggggatagggcaggcatgagaggtctggacaggtgctcagaggggctccaacaggcaagggggcggggctggagaggacaaggacagagggagagcccaggaccttcacttcccaagagaacagcaggagcctgagctggggatccaggggcaggaggctgggagctggggggccaaggcactgagaacatagggcacagccccacctcattgaagtgggcatcctgtgtggctgtcagcccgaagccctgctgatggctctcgaaggccagcaggtgggccagcaggcgggcagtgactcgaacatcttggctaaaatagtggtcagtgtggccagtcacctcccgtagccgctgagccagcttcttggcctccatggtatccagtgccgtcttgttcagctctaggccatccagctgccaagacaaggagatggttgctctgtggtcccttaggccttcctctaaagcttcacagggagaaagccttgccagattaaagggcaaccaggaaaggctcaggagttcaagggctagggtgtggtatctggggcccaccacaggccaaggaaggtcttaggttgcaggaaaaggtctgggcagtctcaccagcagactgagctctcgaaaggcaggggaggtacagttgaagaggtcgggctccagccaaccctgggcctcatcacacagccgcacagcagcacctggaggcaggcaacccctggtcaggcctggggcctggatacctttgctgaggagataaccgcagcaccctctcctatgctgggggaatccctgaggcagaagtcagagtcatgagcatctatagctgcacccctggaggtagcggcccaagcccaggtaggccccagctgcttgtcaggcaattcctgagagggctgtagaccattctcaaccagcaaccacacaaagcacaagggtggggctgcacacactcacccacgtgggccaggactggctcatagatgtgctggttcacacagacacacaccaatgctcaccaattacacacagatgtatggaccagaccagtacgcagacacacaatgctctctcgcacacacacagacatgccaacacagaagagggcttctaggaacatccagtgaaagtcaggtgggaggattctcacacaagttttaactgccccagtggttactttgctgtcatttctctcccttgtctctggggttgggatggaggttgaatgagaattgacttggatcttaaaaaagtttgtagctaccaacaagagagagcctaacttaatcacagaatcccctccccgcaacaggttcacagacacgtgcacaggcacagagatacacacgtgagcatgcgtacacaaacaatctctgtccagccactgcagagacctcaagcagcagggagtgttctgaggggacctcaggcagtggggaggggcccccaagcagcaggaaggagctatagggtcctcagactgaggagggatctttcgtgacctcaggcagtggggaaagttctatggggaccccaggaactgagaaggggtcagcagggtcctcaggcaatggggaggggtctctgaggatctcaggcatcagagaagggcccctggggtactcagatagccagaaggggcctgcagggactttaggcagcagggaggggtctgcagggacctcaggcagcaggaggggtctgcaaaagctctggtagtgggagggggcagtgcacctgagcaaacacgtaccccttacctgcaccccgcaatcctgcccagaagccaagagaaacagatggaggctcaatgagggtgtagggaggggcccacatggactcccaccccacttccacctctttgcaggaacaaagccacccaatttaggaaaagacatggctctagcagtcagagtacaggcccacccccaccctcagtgatgtcctttccccccacatactcacccagggccccccggggacagggcactgtggccaggacgccaaactttgtctggggccaccacacaccagatctcagggacttagggcaggcatcatagagcactagagagagaagaggtgctgagccaggcagtcagggtacagggcagttgacagccacacccactgcccctccaccaccccccacaaggcccactgcccgccactcctgctggcttctcaggagctgacctgtcagattctgtgacaggtcagcaaagtacttggggcaaaggtagggttccctgggtgtaagtggtctccctcaggagaagcttccagagtccccaaggagccatgtgtgccactgacacgtgatggtggcacactggaaccagccctctatgggtggagctgggtggagcctgctcaccccggcagccgctggctgtcacctctgcgaagggactgtcacagctgttgcactggcggccaagggctcctgggcgacaggggcactgcccgctgtggggtgcacatgagcgcgaggtggagcccacagggtagcagtcacatgggaggcaagagtcactgccccgcggtcggtagtggaactcctgtttgaggatgggccaggggcctgaagtcagaggtcagggcttggggaatgagtggaatcaaggataaagggtcaagagaacagtgctcatgggccagaggacacctgggtcatgcgtgaagccaagggaggggtcacgggtaaaggatgagagacagcaacttggtcacaggacacaggcaagaggttagggcccaagtcaggtggcggaggtcagcaagctggacaggaattgcagattgcgtccaaggaagggttaaaaggtcaggggccaggcgcaccttgcagtgacactgcccatttgtcttgttgcagttgggatcaaaacctttgtgaacatcacagttgcaggggccacaggttgggctcccccaccagccccgtgggcactgctggtccatcctgggggtgcagagccaggtaagatgcctccacggtatcccagtgaccctccctgtccctgccaggtctccccatcgcctcagccccagcctcttacctgtgctcacagtggtgcccgaaatagccacccacacagtcacaggtatagccatggggggctcctggcaggtgccggcatgatccctggttctgacaggggttcaggaggcaggcatccacacagcctgggccgtagtaacctgcagattgggtcagaaagctcaggatcctggtcgcagagcatggaaggaagcaggcacccgtcccgagtccctgcctccttcaggttccccagtcttcatcatgggcccctaacgcctgcccaggtcacccttcccccaaccctctcaaggctcacctggctggcaggtgcaagaaaaggtctgccagaggtcccggcagtctgcgtgaggtgggcagggcccagaggcacaggcgttggtcacaacacagccaggctccgcattcactcggtggctggggggtagcagggccggggagccagagggtgtggagccgagccacaccccctgtggacacacagccagcaaggggtgagaccatgttaaggcacctcagcctcaagtactgcagagccagccacccggtctgatgatccttgacatgcagtcttctgataccctcaaaaaacccaggcctcaaaaatatccccaatttggtacccctgtgggaccctaattgtgctgtttctgacacagattcctaaaggcccttgataatccaagctagactcccacctccaatgccacagaaaggcttgacctagctctcaactctgggtcattcaccccctcgcaccaacccccacttgaatactgcctttcaggtcccaaggagcccctgacttctgacccctgaccctaatgccccatatcacattcccatgctgacccccacctggatgcagccaaccagaccctgaggagcctcctctgcactgccggggggcaggcctcccacgtggagctgctttaccttcaggccctgcagctcactccccaccgccatggtgtcctggaggaagtggggcagtcagcactgagggagaggggcctgatgaacccctgtcatagcccagagtcagtcttggccttcttctagcccttctaggctgccccctccctcctggacccacagtagaccttaatattgcttgattttgaccgggggtgggtagagactggggcagagactagaaggggcttctaggaatcaggcaaagtgctggctacagaggttccccaagaccaggccccaaatctggcacaaagagggcttgagagtggaccaacttggctggtgggtgggctcagtgcaaggatatatggtggggaactaggggtagaacatcagactcagtgcagtggagggaactgagaggagctggactagaggtggggtcaaataaggcggatctggttggaaggctgagaacagactaccccggggtcagaggccagacctggaagaggctaaagtccagtgagaccataaggacatggtggccccgccggccacctggttcctcctgcaactccagccgcagatcgtgccaccggccatcactgacagtcacctggtccagaaggagatgggaagcacggcccgagcccctggtcactgtcacagacagtaacccccgatctagctgtgggcagagatgcatagccctggggttagagccccatgtgggctgggacttggaggtgagatcagagggctcagaggtcaggaatatcagaggtcagaacagtggggtcaaggttatacctggcacaaagggcactgtgccaggggacatcatgttgctgatatggggtcagggggcagaggataggaccaggtgttgtgggtgggttggtgcagcttgcataagagagagctatgctggagccctgcacctgcagaggatataatgatggaaagagaatcaagggctagggtccagagcagggtcaagtgtggttgggacacctggcagaaaagtatgctgtgtgaccaacctgaacccacaagaatgtcagtggcggcctaagagactgagaactgagggtataggggtgagcagggtggacacacctggcaaaggagcgtgctgtgtggcccagcctgcacttgcatcaggaccccctgcgttgcccgtgtccgaaatgccagccccaggtaccatggcacagacacagccatgtcacttccaaagttccagctcagtgtgccgttgccacggaaatggtggggatgggccatagctgagtggataagagaaacagggttacagcccctgccccaggaacagatctgaccctgcaggcccctctgccccatgctgcccacttactaagctgacagtctttgccgccgaagcccacagggcagtcgcagctgaagctgccccagcgctccgagcagaagccactgttcttgcaggggcctgagtcacaaaagtgtagcttggcttggcagcctgggagaggaaagcacatggcggacatgagaacaagggttggggggcacaagtgctggacaggactttagtgtccagaggggctgaaagagaccaagatctcagccccatttcccattttctttcgatgagtggggttggtaagagtcaggccctaaaatctgggctgtagcatggtgcttgccaccaaaggagactggcttgaagtcaggtatggagtcctccacttcctccctatgatggggacagggccatgggctaggctggtggaagcttcaggcctacctgccatggtgccattatttgcgacaaaagccgccatgtccactcggcggccatcaatgtgcaggtcccgcatacagccgatgaagtccttatgggatacggggaagttctcggggaggttggggacacctcccagaagaagagggcccgtcaggtccagggacctggggatcaggggtctgggtcattggtgggactggggccagagtagagttgctcctggggggccacaggaagcaggggggtaggacccagagggtagggtgattgagggaggaaaataaggccgagctgtggaaggagttaggatcttacttcagttggggtgcaaaggggcacccgtgatgggccgatggtctggggaaaggtaggtgaatgggggttgagagctatgatgaaagaatgaggcatctggctggctggggaggggatggagacgtgaagactctgggggactggacatgagatgaagggactcggaggggatgtgggacattagtgagactggggtggggaggtggaggctttggaggactgcctggggactgtgtgtgggaggagggagtatggggtggaatacaggattgggggctagggtgagtaggctttcagggtctttgagaggagaggggaatcttggtggtttgggggaaagatgggagagtttggcaggatgggatgaggaatgggatgtgaagggttggagtgggctttggtaggcaggggacaaggggactagggggcaggggcctcacttcttggagcttgtttgcacaccagcagccgcgcatgagtagttgccaatctcagcaccaaactgcagagccacggccacatcacaatcatccacgcttagcacagccaccttgtccttggaggggccctgtgcaccccctagggcatctgtccggggctgaagacgcaggcacaccagtcaacagtgcccccagtaacccctgaggagcagaagtcagcatcccaactcccctcatacccgatgccagggatggcccccaccttgttgtagtatctcagatgcactgtatgccattgcccgtcactcaagccccctggaactgtggggctgaccacggtgttggattcacctggaggggagatgcatgtggaatcatcaggagcagcggagtcgccccatcccacccgtcatataagcacaaccattcccagggccaccctggatgcatcagatcagtccccccactggtgaccacaatggctggctcagagtgcctttgaacagacaggagaaacagacttcttggagggagggaccttcccacagggaatggccaaggagctaggtcttcagggcttgcatggcgtggagtgtgtgctcaggtgcacagtgaagcaaacctgaggggacttgggccctgcgtcctccagcacacacgcaccctttcgccgtcacatccggggcacccacccgtggaatatgtgagccgcacttggccagccacgagttccagggccaggaagtcgtgcttctcgttcaggcgcccgttgtagaagagcagcccgctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgcaaaagtctcccgtgaatccgggcgggcagcggcagcgcaggccagcgatgggctggatgggtcggaacagcgtggaggccgaggccaggaagggcgcggacgagtcaaagcggagcacggacacgcatttcatgtagttctcacagggctctcgcaggcacacgttgtcgtcgaagggcagtacgtcgagcagggagcgagccgccagcgccgcccggcgcacgtacaactgctcctgcagctcctcggagctgaaccagggccctgcagcgcccgccccggccccacgtggagctagcgccgagaaactcacattgagcacggtgccccctacgtctgtgtcgttctggatgttgaagatgaagacgtcctcagcgggcgtagcgagcaccgcagccacgccctcgaggaagcggcccagcagcggtgacaggaagcgctcctgccacatgttctcaaggcgcacggtcaggctgttggccagcaactcctccgtgatgatgaccacgcgcagcacacactgcgccgtcacgctgtgcaggccatctgcaggcgggggcaggggcagtggtcatcctggggacagtggccacccctccctgggacacaagagggctggggccagcgatagcctaggcccccagaacctctaagtcagcaggctgaccccaccaggacacaagggagtctggggctagtgaccaccagctcccccagcatcaaggtgtcaaaaagctgctgcttcctcccccaatccccaatacacggaggggtctgggccaaggatcaagcaaccccacacagtgcccatgggttagcaagtcactcccgcaacagcactcaagtaccctaagtactcagtaacccacacttccccaagttatcatggtcagcaggccaccccaactcaggacacagagaggagctagggccactggccactcattcccagccacctttcccttctcccctcctccagcatagcagaaccagcaaaacatccccctccagaaaagaagggttccagatcagggatcacctatctcctatttttggtcagcaaattgctcttccatgacactagaaggggccctggcccagtgaagactcaatgccatcctccagaatcctgggttatcaagctccaggggggtcttgaaccctgacatacacacacacacacacacaccagcattcttgagttagcagcctgctcgccactccagacctgggtcctgtggtttcacagtgaccaccccagagatgaaggtgaggtgcttagctgccttgttcgtcttgtccccacaccctagcacatactgggtggtcaataaggatagactgttgagtgagttgagggataaatgaaggttgtgccttctcaggcagtgccaggagtccctgctccagaactgaggaatgagcaccagtgaagcctatttcccaacctctgcagcctccagtaggcagaacttcaagagcctctcccacctgcactctcctattatggaggggtttctgaaagactggagcagatggggcaggaaagaggcaagtggacctctggacattttcccaaaggtcagggtctcaggccctacgaagccactgtccacctgaagcttccatagtaagctgctgttcctgaccactcaagtattggtcatttcctgcacagatagggtaagcgtcagactggacccaaagtaacccttcgtctgaacatgggcatagtgtggactgactggcccatactggctttgcctaggacctccagaggattaccccaggacctctgaccttttatcaggaggggagatatccctaggtagcagacagttctttacaggctttatggggtctgctagatgccttggaatcactgggattctgtggagattatccaggaacctaagcagagtccttgtgaggtctgtggcagatcttgtagggtgcaggaaccctacccttaaggggttcttggaaggcttagaaatccctctttggtttgaggtgccctgtggagtccctgaggcccaacaggttggtgtcactgggtcacttgcctgccccctgcccctcacctgtgacagtcaccaacatggaggccaccagtgggcggttattgtctagctttcggctgagtcgcagctccccactggtctggttgactaccagcagctgcagctcattgccacgctcaaaggagtagaagaggtggtcggagacatcggggtcataagctgggatgcgcccaataatgcccgacgggaaggtgtctgaacggttggatacatagttgttgaagaggatctggaagttgttgagcacagggctgttgtcattctggtcaaccaggcggacgtgcacagtggcccggctgaccaaaggagcagatgtggcctgcaccacaatcacatattcttggcgagcctcatagtctaggtcaatgagtgccgtcagttctccagagaagatgtccatttggaacagctcagggatgttcccctccacgatctggtacattatatgggcattggggccttcgtcagggtccactgcagtgatctgggccaccactgagcccacaatgctattctctttcacccgcacctcaaactcctcagctgggaagacaggtgcattgtcgttcacatcctgcaccatcacctggatactgactggagtccggagtgggggcacacctctgtccactgcgtaggcagtcaactcatacactgatactgcctcccggtctagccgccttactgtacggacaattccagaggtgggctcaatggtaaaatctccatccccatcttcaccattctggaaagtgtactggacccggccattggcatgagcatcccggtcagtggctgagatctgcaggacactggtgaaaggtggggcatcctcagagaccagccctgtatagtgggaggccacaaattgtggagcattgtcattcacgtcattgaccatcacctccacataagtagtgtctgccttctgtgggatgccattgtcccgagctgtgatagccagggtgtaggtcacctggtcctcatagtctaatggggcctgtaatgtaatggctcctgagtctgcatcaatgcggaactggggcaggttgtcctccaggagataggtgatacgagcattctcacccacgtcatcatcagaggcactgatgaccactatggtgctacccattggccgatcttcattcacactcactgagtagtgggcactttgaaagaccggccgatgagtgttggcatctgtgatgttgatgtgcacatagcagtgatcatgaagggcacggtcagatgcagttagtaccagcttgaagtagcgttcctgcttgtagtccagtggcagagccagagtcaccagacccacacccccctgggtgctgatggcaaagcgattccgggtgttgccgcctgtgatctggtagctgatggcactgttggcatcacggtctactgcggtcacgctgaccacactggtgcccacagctgcatcctcattcagtcgtaggtggtactccttcattgtgaactcaggccgattgtcattaacgtccagcacagtcacggtgacactggctgaggcagagagtgggggtgagccatggtctcgagcctccacaccaaagaagtaatgctccacagactcacggtccaggggaccactcacagagacccagccagtggcgctgtttatcacaaaaggagtatcaggtgccacaccagttagggagtactccaatctggcattctccccatggtctgcatcgactgcctgaatgtggatgactgagtgacccaagggagcattttccaagacagaaacttggaagggcgtgctgacaaaaataggaatgtggtcattgatgtccaccacctggatgctggccaggcccgtgttgttggacagcggtggccggccagcatcctgcgccctgatgcgcaaggcatactctctctctgcctcgaagtccagaggtgccaccacctggatctcgccagtgaggctgtcgatggcaaagtgtccacggctattgccactgatgatgttgtagtgcaccaatccgttggcgtccttgtcccggtcagtggccgtgacgcgcagcacgactgtgtgggggcgcacatcctcgcgcacctgcgccacgtagcgcttctcgctgaactgaggagcattgtcgttctcgtctagcacagttatgtgtacgcgcacagtggccgagcgcggcccgggttcctggccctggtcgctggcttccaccaccagctcatagctttccatgtgctcgcggtccactcggccgctggtgctgatgaggccggagcgtggatcaatctcgaaggcggcggcagctgcagcgcgcgcagctggcggccccacgaagcggtagcgcaggttggcgttggggggcgcgtcgccgtcagtggcacgcagctgcaggatagggtagccctcctccacattctcgcgaagggtctcccggtactgcgcttgctcaaaaaccggcgagtggtcgttgcggtcggctactgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgccatctttattgaggacgtgagcgttgctcctggtgctgaacagagcgcgaaggttcgccgtcgttgggtccgccctccccactttcggtcgccgccttcacccacctccctccttctagggcgctgtcccagctccgtctcccagcctttttctgtccttccagatctcttgttcccccttcctgaccactagttctgaaccgtgtcccggattttggtctgaaattttggtgcccatgagcgttctcatagctctgggagggggtactgtgtgaaatcctggggtagaggggacgatggctggagaggggtctggggtgccagcaccccgaacaatagctttaactatcccatcagctagttttatgaaacatgtcgcgaccacctgcttgtttggatcgcccctgcggagcagggaccagagatgaccctcccgaggcgggagcagaggccaaattcttccctgccttgctggtccccagcagtctcccgggctcggggccccttcactggaggctgcaccccctcccaggctgcgagtcccgagtgctctgggatgccacgtggagcccggcgttgccccatggctgcgggccccgcttcttcgggtccccgcccctcgtccgtcacgaccgcatgccttaaccccttgaagggactgacacagaaactcagtcctccccccaccctcggtgcattccagctctccctgcgtaactcctggcacgcgccggtctcgccaggccaatgggtggacctggcgcaacagacgtcacgagaggagcggaggcgaggggtgaacgcgg

SEQ ID NO: 833 - DNA, 3959 bp, Homo sapiens
ttccaatttccaattactttctacacatcctctcttaacataaaatgactttcaagcccattactacaagacttattacaggggacctatggacttgtgatttgaatcgtaattagtattaatttaatagtctcttcacagagttagactaatatgtcaggtgacacagtgtcttagcccagccacacacattgatatgactctgatgatggcctgcctctcagtgaagtcagagcagggggtacaaggactcaggcaatagacaagagagaaaagaaagattaaagcttactgtttatagtgttttccacacaaggtatcatccctgacaagtctttctatgccatggcattgattattagaagaaagactcgtaaaaacctctaggcaggtcagattttggcagacttaaagattatgcagacaagagtaggggtcagggagtcttatctgagagctgccgggtactttatgtgtgtttcaggacagggctgaccacagtgttggctgtggaaggtgggggctggaaacctctgctgacagtgatcttatctttcccatgtgatagtttcattaatgactgccttcacctgctctttttccagtatgttgcactccaatgtaatttctgtccgttatcaggccttgatgtcatctatgccctgaaattgtgttattgaactaacactcattgtcaaacctttacgagataaacctattttatttctcctcatcctaaaaatgtgttgattctcctgtgctgtgtataatgaatggccctttggctgttgtaacaccttcactgaaatccttgaagtgtgtgtgtgcctatctctctatgtctcgccccctttcgcctcctccccttcctcaccccttgccaccccttccttaccctccccaatctctctctctctttcctaaagaacaaaaatggcagtttcccttattctcatagaaaagactttatgtcacagaagggagctgctattagcataagcagtctggcattgtgtgggtgagtgtccatgtgcattatcaagcaaggcttataaaccatgttaattccacacaactttctctactccatccagcttccaatccgtaccccacaacataaaaagtgacatcactcacttaagaaaatgttgcagtaaggtggattttcataaaataaggattctcaggactccaatttttaaatcatacctgtgtgcctacagaaaggttggaggggggcaagggagtgaggatcttaattggcacccaaggcagaatgtttgctctgaggagaaggattgagtggcactacttaagagatgcagcaaggcagtgcagggagagcctaaaagcagctgaggctctcaatgtcacccagacactgatggacagtcattgatatttgaatctgaatctgaatgtgtactatcaaaaaggctgctgtcatcattgtcaccactattcctctgagtccttttccatctctaccatcttactctctgtaacgggattgtaagttctatattttgttttatatcttgtatactttgcttgatgcagtaaatatgctactgaaacactgtgaataagtaaaacttcacctgactgcaacatttaaataacattaaattcatctgaatacagaaaaatataaagaagaaaacaaaaaggtctaaaatcctatcaccaagatagccctgttaatatttgttaaaaatataagtatgtgtgtggacatgattagagtgtctatatttgcatagtataaggggtaaattatactagtacaattaataggtataaattgaaaagcacctacatttctttcgctcctaccccaatccttagcccctccctcagcattatgtctgtgcagtgtacaaagcactcttataagaatacagcaatgggccggcacgttggctcacccctgtaatcctagtactttgggaggccgaggtgggtagatcacctgtggtcaggagttcaagaccaacctggacaatatggtgaaaccccgtctctactaaaaatacaaaaattagcctgggcatggtggcgcacgcctgtaatcccagctacttgggaggctgaggcaggagaatcacttgaacctaggaggcggaggttgcagtgagccgagatcgcgccactgcactccagcccgggcaacaagagtgaactccatctcaaaaaaataaaaaagaatacagcaatgactaaggcatctccctggccctaaaagggagtttcagcctaatgggtcaaagaatcataaataaggcatataaatagcatgatatgtgatgtacagtaagttggcagctggcagccatgagatgtgatgccaacattaccctcagctgctacaggtctctgttgtcatcccttccctcctccgcctcacctaactagccacatgaccttaaagaaatacctgaactgtctttacccattttatgcatttataaggtagatgtgataattcctccctgcctgatctgatgagctttgagaatcgagtgccagaatgggtaagaaaacacttcacgactcataaaacagaccagaagtgtaaggtttcattgtcaactttattgttatacaaaggggtactatgaagaatcatagtaatcttgggcgttaatttaatagaaagcccgggagcacagggtcaccaacagcccagatttgaccaacagctgcctttcgcttggcttgtactgctttttaaaagaaaagttgctaacgtttaaaaatcaggagagttcatacaaaaaagacttcccttgaaaaatcggaggaaacattcacagtggacctgcattcctacgcggcagccattttcgttgctgaggaactgctttcccctgagcacgtgttctcccatttgtcacaagcccccccgactcccttttgtagccccaacactgaaacctgatgtcagtttcacttgtcatcatgcttgcccttccttagagccagaaaatgttttagaacccaggttcccatcaaaagtagcagggtaaatagctactccaagaaggccaagatttttcttataccttacctgaaagcattggagtttgcaatttcaatttaagatctgcagaatattcaagctgaaaggggcctggaggttaattaatccaaacgtcttgtttttgagttccagagaggttaagtatataataaaatgtttagcattataataaaatactttagtagggtccatcattttctttccttttttttttttttttttttttttgacgcagagtctcactctgtcagccaggctggagtgcagtggcacgatcttggctcactgcaacctctgtctcgcgggctcaagcaattctcctgcctcagcctccggagtaactgggattacaggcatgtgccactacacctggctaatttttgtatttttagtagagatggggtttcaccatgttggccaggctggtctcgaactcctaacctcaggtaatctgcctgcctcagcctccgaaagtgctgggattacaggcatgagccaccacacccagcccatcattttcattattactaaagtaacaattttggattcccaggttttttagtcatttagtcattcagtacatatgcattgagcaatgtaatcagggataagacacttggggtttcatggaaaagaaactttttatcatagtgctttgtatactatacaaactcataatgctgggggaggggctgaggattggggtgggcgtgaaggataagatatttgaggtttctgagtcccgttttcctcatctgcttagagggagaatacctgccctccccactctgaatgtttgaaaatcaattgcaagtatgtttgtgagccacttagtagagtttatagtactgaacaaatcgttattacaactttgttatgaatttaactgagaaagttttaaaagtatttataacta

SEQ ID NO: 834 - DNA, 225079 bp, Homo sapiens
aagacattcagaagtgtattgctcacctataccatttatagccctaattttcaaacacaataaatgcttcttatttcacctctactcattcagaatttgcaattactgaaattagagctgaacagaagtttaattgtctattgtccatatagaatagatttcaagaaaagtaataacataaaaaaggaaatctcatttttaaaaatcttcagtcaagtatcattcacatccagtcacttgctaattacaattagacatctctatcaaagccagtgttctctgctaaaggtggtgttccaggacctctgttgaaaaactttgccactccagggtttctcagttattgtctaaacctaaaagggaataagattcttcaaaaattattattgtcttacctttcagcaatataaaatgtccctgctcctcccaggtctctggattagggaggtttttctgtgaggcaaataatagagcaattctattccttaaatagagagatggtcacactggtgctaattaaataagctgagcatgtttgctttgtgcacttttcagtacatattttacaatttaaaagtttgaaaaaataatttaatcattaagagggcagcttcaatttagaagaatgaggaaacagacataagcaacccaacaattaaactatcagttccctgttctaggagtggttcaaagttcagaaatgaaggcctacttgagaggcagtagaggtaagtgtcttttattagtgcagaaattctcactcttaattactgaattccactcagtcattaaccatactatagtgcaatgctaactacataatgctagtagatagagtgtctcctacattgagataccagtgtttgccagtgtgtgtaactaaagcaagcctacagccacatctccaaaacctgacatcggctcttacatcttccacattttgtttcaaatctttctagggatagttctttcaaaatccctctcatgtgcccttctcagtcactatactcaaatgcttttatgagataagaaacttaaggagtatgtgtctggggatatttttaggaagagatggattttgtgcagctgattattaagtcaaataatgaattaagaataatgacaacaattgaagtgaaaaatctgcgtcattacagtaatctttctctcttgaacagaactatttggcttaaatcaaagccacctgtaggattatgaatttcaaaccactaggagtgaggcatatgaagtttctaattagcactggccaggaaacattagttctcccctttgcggtatcttacaggtggggatagagtgattgtatgttctcaggagaaatttgcagttaaaatggcctagtggttcagaacttggactccaacagaactgaaataatgactgtactatcagaaaaatataggtgagcaaggagtgtggggggaggggacgggggggagcagatctttccaaagaaagattgctgccagtgaactaattgactatttaatgtgtttattttacttgaccatctccaggagtgatacaaaataattaaacagcctgtatgtattttggtgatttccatatatcctaaagtactcaatacaaagactggcctgggccagagctggcatgactgccctcagcttccagttctagtgccatcttatccctcctaatcaatttcctctgggcagagatgtccaacaaccaccacagaaaggcctggcttagaatcttatttttataaaacataacaacttcccattgacacacattattgaatagagatactcttctgaaaaggttaggggtctctaagaagtaatacaaagaacactttaaaatgtagtaacttacatatttttaaaattaggtataaaaagatgcaaagagcactggtcattgtagaaatcatttcagtttaaaattcaggtcctgccacgcattagctatgtgactgagcaatctatgttactttgttgagtttcctagtgtcttggggatgaactgtgtctcccacaaagggtgacttcttccctactgcttcagcactcacataggcatccttacacacacacactacctttgtgttctacttcaactgctttcagttagtctgttcacaaacaacttccttaaaaactgatttccatcttcaaatcagagtaagcatcgtgtacacaaagcccttcctaaatcccatttcctcctccccagcagagcttagttgcttctcctttgtgttctaacagtatttgactatagcacttgccatgtattgtaactatgtgtttaagtgcctaactccacctctagactgcaagctacttgaagtacatacagtttttgaatgttattggtatctctagttttttaacagtatcaaaactgacagtaagttctcagtgttacacaaaggagttgattaatagcagtgttcatttcttgtatacttactatgtgctaagcacttacatgcattttctgtaatcctgacatgaactctctaaggtggacattagtattttaattttatagaagagaaacctgaggccccaaaacaacaaataagtgattaaagtcaggatttgcccaatctccaatctgttcacaagggatctagcacaaccacctggtacttattaggtcctcaaaaatgccatcttttttcctactgcccagaaaacaatgggaatgtgacttctgcaatggaagtaccagaaactgtgtccgttggtgctggctaacactattacttagaaaattttgatacaaaaagctcatttcaccaagtctgtgtcagcaaccataaacagatttttcaattgcacattaataattcccaaaaatattttccgagtgcctgctctgtgccagttctgtactgtacactaaagatctatgaataaaaagtcaagaccccagtctcaagaagcagacaccacgaggtaccaacatttgtagagcacttgctatggaaactttagagcacctgggaggacataatcttaatggacagatgttacatgcccattaaacccatcattaggggatctatgaatcatttaacggaacatagagtagcctgttctgtgccatgtatgtggccacaggagattcttttaggaagataatgtcctccatttgccaatgtttgtgttaaaattgaagtgcagccagcccacaggggtactcctaccagcatgtacttaggggattgatcagggtttccaatgaaatggcaatatggcagccacatagtgaagcagagagcatcaagacataaaagccgttcattattgaaactttacaacaaattccctgacaacctttccctggagaagccccttgtttctgccaacccattacatctattttgaggctggcaacctgatgtgcctctgcacacaaccccaagaggcacccttcatatacaatacaacatgatgcaaatacatcttgattggttcctctggagctgtgtgacaaggtggtcctgactaccaaagtaattaaggttctcatgcaccttcagttgccaagccattatcaacacatttgattttcagggaacatgtgaggagacctctgagcctttgtggcacgaatttaccaaaggggagcaaagcctagtgagtgaggtgcctctttctgcccaaaagtgcaagtgcatgatcagccatatggaagagatcccgggtaattactctcggtactttcgtttagctattaaaatgccacccaactgtcaaaccttcactcagtgttaattactgccacaccgtgtttgaatgcagcacaagtaggactgaaagtagaaaataaataataactatgcaaggttacagcctctttttgtacctctggttgcagtaaccaccttcgatctctttttaaggcctttcgttctcaccgtcattccctcatggactgagcagttgtttacaaattgcaaatgcctatgaaaagcccctatttcacagggtctcgcacacagccactcaattaatggaactaaatgccttggttaggttcacagaagctgctgaataactgccatgctgcacttggcatttgcctccagaggaagaacatgatgctgggtgatgttggtgatctcacctcttggtacattagctttcagctgaaagttcaaggccatcaagctgcttctctgactggcagagagggtgcatattaacctcacacctatccttcatgagataactgtgctggcttattctgctcttggactggagctatattttatccagcagttcttaacctgtgcccatggatgttgtgaacctgctaaaactagatactatgctttgtgcatgtgtgatttataggaaagggagcccaaacactgatcatctgaaaggactctaatatctagaatcttaggtgacctttcaacggtccttcaacacaagctgggcaagtgtatattcacctccatttcataacagaataaacaaatgctgagctgtgacttgcctgagtgatctgagaataagttgaggcacttttccagtactaattaacatcttcccagaggatgcatctaccatttgtaatatgtgagatgcatttatctcacataaatcaccttcgctgggatgatttgtctttcatctagactgtaagcccaaaagacaaaaactatttttgtctgtcttatcatctccatgtgtgtgtgtaatagaggaacagtgtttgtaccgaaggggatcaatgtttgtcagtctaaaacatgccatgatggcataagaattattttgagctaaaggcaactgacaaacatcagatgtatataaagctgtctactccccttgtatctgcctaaagtcagggcataaattttcctcagtgaagatgttctctctttcctctcccataccaggaagaggaggcaactcttattgctgaagatggcactgacttcaatctgcataaacaaaattgactgtaataaatcttatctttcattagttttccccatatacttatcttcacataaataagtacccctagaagtccaaaacccctttcttttctcttgtcatattgccacaatttattgttctttgttaagatggtatatataagcccccaattctaaccacttccttaagttatatttctttgtgaacttccatgcatatgtatgtaattaaatctgttcttttctcttgttaatctgtcttttttcagttaacttgtaggcccccagtactgaatctaaaatagtggatgaaaaagtcttaccctttcctatagtatataacaataactgtgatcagtgaacagatgcaaaccaaccttcagtttccaaaaatatttatttctgttttctgtcacaagacacctgtaggacaattttttttgatgaccataagatgtaaaggacaatgcttagaaaaacctagacaccaagaaaaacctgctaatgtctgcaagaaaagaacttcataatccagaagttcccaaaactctataattgctgaagaataactagaattttaacaaattgctcaaaatctcctttcaagtcctcacaaaatcagctaattcattaaaaagaaattacattatatgccccattacatttcataggacactggagatggacacaggcactcaggaaatactgggaaatagggacagtgatacaaatgacaataagataaaacaataaggatccagagaatggcatttgaaacttgaaaactgtatattgaaaagggtgattccagaaatttaatctggtcacaatgtctaaactggtggctatgagaaaggggaggagagggatggagtcagcaagaccagataaaggcagaatgacataattaatgtgtagcactttcagcatatgaaaacagcacttccttcatcttcccaaagaccatcagcgttgatcatattttattattaagaaaatacaggctgggcacagtggctcggcctgaagtcccagcactttgggaggccaaagtgggtggatcacttgaggtcaggagttcgtgaccagcctggccaacatggcaaaaccctgactcaactaaaaatacaataatcagcagggtgtggtgggggatgcctgtaatcccagctactcaggaggctgagcaggagaatcacttgaacccagaaggtggaggctgcagtgagccgagatcgtgccattgcactccagcctgggtgacagaacgagattctgtctcaaaaaaaaaaaaaaaaagaaaagaaagaaagaaaatacagttatcatactgtattcagtgtattcaatgcatactttgtctcatcagtgaggaaattttcaactattttctgggcaaaaagagtaataatccttggtagtaataaccatttatctgaaagaaagcacttccacaagctttctgtcacattttaaaataaaaaaaaaatgagccttctccctttacaatgcaggcatttctaggaaccactgtaaaagggcccactttttcagtatgtctaagagcagacagcactttccaccacctgccttgcccactctctcctagctcagtgcactttctcaggttgcacaagtacgaacacatggagaatgcaaagaatctatctaagtttggcagtgcttgctgcattctgcctgtagaagtgcccccaaatggtgcaagctgaagcaaaacagccgcagaagcaaaatacaatctcgcggtcagtgcagacccagctgcccttgtctcttagacattcctggctggaatcccactgagcaaatatagggggaaaacagacaagaaaggccctagattcaggaaatacccagctgctgcaggagagagcagcttacaaacagcaatttccctttaaaagtgcccccaagggcagatctctaaattatccctcgatatttcttttcaatcatgccatgaccctaccactggtttttaaactcctcctcttgaaccatatgatggacctacaagcagccagtaggttctcaaacacagctttcactattaggcctgaaatccaaagggaataacgttaccctctcatagcatagtttcctcattcagccatttctcaaaccttttttctccaaaattcttgctatcaagagtgactgttaataccaacagaaggacaagccttcaaggaacacagtaactgatctctttcgtaattttcatttgtcaaactaagggaagctatacaacttagaaatcaaatgtcatgttcatttatcaggtatttattctattccaaatctacacaggacacggacagaaaagattcatgcattcttttgaccgatatttattaagtacttactgcaattcatcaagtctaaaatacatattttttcacattttgacatttctggaattgggatgcatctgaaaattaagattctggttttcttcttttagtatataaaataatatagcatcttacaatcaattgcacatgccatggacgaaatgcttaaaacttctcaaatgagtacagccatcttttcccttgaacttgtcctcctctttcaaatgcatcctcagaggctggtaccagagtaatttttatctggggcaaatcttgtcctgtgacccttccccctgtttgaaccagccaatgaattccctttacctatgggtaagcatggagtcagaggtccttcatgacatgtcccagaccaacactggcagctcatctccccttgtctcctgccaaattataaattttcctcaatataccaatttctctgaactcaatataacttttagaattctgctcaagtattgactacctgaaaactttctctgacacttctatccccaaggttgaagtaaatgtcaatcttttgaggtcccacagcctcctatgctttattatattattaccacactctaatttggggctcttgatctatgtcccccaaaagaccaagatctccacaaagggaaaggttgtgccttgcacatttctgatgaaaaaccccagggacactgcctggcatggagttgaagatcaaaacataattgaaaggatggatgaacaaaccttatgacatctcatcctcagttcataagacacctagcttttagagatcatcagcaaccaaacaggatttcaattcttgttactcttgggttttgtctaaaaaacaaatgggaattcaagaaaaattgtttcttagtttctttccattctataattttgttatttgtgctccactgaaaattacctgctattctatccatctggcattgatcaaatactgcctttgcctatgaagcacctttttaaaaatggattctcagattggcaaaacagtctcgcacctaagattcttgagctgtgtgtgtgttgcagggggaggagagaacatgtctaaaactccggggaaatacgtcatttgagagcacatatttggtttaattttatacctagaaaacaaatgctctctgcattataaactaaacaatatacggcttgataaggtgatcttggctgatggagaaagaaaaaacgattgagattctcaactggggaaaagacatgatatttttatgaagtttatcaaagggagatatgagttttagaagttcaggaaaaactggcacagtaaaagctaatatggcataatcgttaacagcagattctggcagtagacagacacggggtgaaattccggatctatccctcgctaactggctctttgattctgaacaatttacttaatctctccaagccttccttttgtcatcagtaaaacagggattatcaggcacacctcatagggtcattataggactcaaatcaaagattgcatataaagctcctctaaccgtgcttggcacttaacaggcccctcaaaaatggtcgcaattattacaactattaataacatctcttctccagttaaatacagagcctacattatatgtcccattacattgcataggacactggaaatggacacaggcactcaagaagtactaggaaataggcatggtgatgacaaatgacaataagataaaacagtaagtatccatagaaagacatttgatatttgaaaactgtatattgaaaagatatcttttctacgattaaccaggttttttagattacagttatttttaacttatgaaatacagataccatgagcatttgtgacatatgcgtgcagttcaaataataataaattgaacggagtgaacatccgtgtacccaccaccctgcttaggaaacttaggaaacagaacgttaccacttggaaatcatctgactgtctttccctgatgtaccctcctctcatagcccagggtaatgtcttgaattttatgtttctcgtgtttttcactccttgctttttaaaaaacaggtttattaagatataattcataaaccatacaatcatccaatcaaagtttacaagtcaatggtttttagtgtattctcagatatgtgcaaccatcaccaccataaattttaggacatttcatcgcctcaaaaagaaaccccataccctgtagctaccactcctcagacccctcatcctcccacccactgcccccccaaccctaagcaatcagtcatctactttctctacggagttctctgtcctggacattccataagaatgaaatcatacaatatgtgaccttttgtgactggcctctttcacttagcataatgttttgtaagttcattcacatagtagcatatatcattacttcattcctttttatggccaagcaacatgccattgtttggagacaccaaactttattcctccattcatcagttgatggacattgtattgtttctgtctttaggctattacaaataacgctgctatgaacatttgtgcacaactttttgtatagacatattttcatttcagttgggtacacaatacgtaggagtagaattgcctggttatatggcaattgtttaaccttttgagaagctgaactcaccagcttttatactgatctccaggtggcagaaagctaaaagtatgtcagtgacttatggtgctaaaccaacctattcagccaacagcaggccctcaatgccagtgaaaactcttcataagtagttacacatcaattattcataggtgtgcaaatcctatcttctaagaattgaaattttctagcagttaaagaaagccagtagcaagaagagaagacttagtagaaacaaggctcttccacttcctagccattctcagttgattcttttgactctcagactaccatttttaaggtatttttcatgttgattcagtctactgtgtctgtgttgacaacttcaatgatgaaaccactaaagatggaatataaaaatggactcatattgaagacctacagaaatatcaatgcattaggtacagacaattttttcagaccaatgacttccagcaagtatgtttataaaaattaaatctacttctcaccaagagtctgaattgccagaaatacactggcatgaagagaaagcaggcaaggggtagaaggaaagagattaaggagcagaagcttcatctgaaagcctctgaaatgtggcatctggaaaatctattcacaccctcacaaatcacttttggtctgatgtgccagtctctaaagcctttgatacaagagtgcgaagggcatctgtctctgattttcctactcaacacttgtcttgttttctacagtctgctacactccccttttgttagccacagacagattgatggacagagtgaggtgacggaccaaggagtacattattcacctttacattagctatgttggggggttaaaaagttggccaacacagtaacgcctctgaattttaacacagtatttctgaatgtctttgactcaagtaaactattgctcagagagatgtagactaggaggacctaggaagcagaaattctcagtatcctatcgtgactggaatgaaaacatgctgactgcccagctacccatgtgaactccacattcccctcatcttgaagtgaaattagttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagacctagttaaataaattatgactatctcaatgctagagaatagtaggcaaccgataaaaaaattatgttgataagaattttttatggcaataaatattattaccaaaaaacaaaaaaggaataaacaacactatatacagtttgatccaaattttacttataaaaacatatatatgtgtgcttgcaaaagtaagaagactggaagaaaatatacgtgtttagtggcatgtatatctgagtgacattatagtgataaaaaatttattttattctccattctctttcagtattttccaagttttctgtagcaagtatgctttacttttgtatggaaaaatcaggaggtggggaagtaataaaaatcaaagcagaaaggagtaaaaagttattattgccgagctgttctactctgggctgcatacagctgtccaccaatgttctgggaagctggcccattgtcaggatcacaggacacagcaggagtaaggctctcacaggaatatacaccctgggtgccccagatctgccctagactcagagtggacccgggacctgatgggttttcttaaattggtagaaaccatactctgggcccacagttcccttgccatctaggacaaaaatctaagacctaaatctagttttctgaatttgatttgcaagagtttcaagaaatcatgccaaatttcccctggtgttctcattttcctcatagaaaatgctagattcaggccaggcacggtaggtcacacctgtaatcccaacactttgggaggccaaggcgagaggattgcttaagcccaggagtttgagaccagccgaggcagcatagtgagacctcatctctacaaaaaattttacaaaaaattggctgagcatggtagtgcattcctgtagtcccagatacttgggaggctaagattgaaggatcatttgggcccaggaggtcaaggctgcagtgagccatattgcaccactgcactccagcctgggcaacagagtgagaccctcctatctcacaataaataaataaataaataaataaagtgctagatccagaccccagccagaaagacatttcctccccaagaatattcttccacatcctcctttttgtaaatacagttccatattattcttaatgttgctgaaaaatattttttggaaacacttaacacatgaaagaaattaagcaggacaactaggagtggatggtgtcacaaagacaaggaaagagtctcctaagcaccatatgcccccaaagataccaagatgagacagatcccaaaagcgtccttcggatttggcttctactggtgctgatgatctctaccagattcagggaggactgaagtcagaataacaaagtggtgtgtatacctgagtgatgttataatctttctttaaggggtttgcctgggaatagcaggagaatcaggccagtgctcacagggttgagacaaacacatatctagttggaagctagtgaagaatacagggaaaagggggtcaatgaaaactgaggagagacaggaataatgagagcagatctagtcctgaagaaaacaaaaaaagaagaagctgggaaccagagctccatatttccttctctcctgaattttcatttaggagaggtgagggatcacccttgaatgaaagaggtactttgtcttctggaacctgacccagtgattcttaaccagggagcccatcagaatctcctgtggcaattttacagccaacacaggcttgggctcctcctcctcctcacctcaccagcagacctactgaacggtcctcttcaggacgaggactaggctgagttatttctaaaagctcccaggtaattaagatgcacaatgctgtctaacgatcactggttagaaaggaggaaagggtgatgatggtaggaaatagcttcataggtgtaagagcaggaaactgaggaaggagagggttcagggttctctcaactaggaggtaaggtcaagaagtagagggcttagggagcagtgaagtcttaaaatagtctctgtgcactgctcagaacaaggcatgtgggggcaggaggaggggcaacactttatcaaatgtctaggagcatcaaggtacatcgtggagtgatttttcccaggagggttcagaaatgtagaaagcaagtgagaagcagatggtcagattaatctatatgtgggagtttcagggggatttggcatgaaagagcaaggaagtaatttaatatcaacctcatagggctgttggaagaattaaataatgcatttaaacacagtccagtgcctgacacaaaatgagagctcaataaatgttagctgttattgtcattgctacaaccactgttgttatttatttctggaaccaagcaaagtgatcacgtctgtttcttaggaatctatcaaatagaagtcagcagttgcttctcaattaacagaggaaaaattcgaaagctatgtggggtgttaaacccctcaaacaagaaatgctaataatcatatatttctgtaggcttccattaacttagttttgaatagctagttgttgagcattcttgcaataatgactaacgataactggtaccacttttactataaatacagcagcacaaaagacttaagaaattgaatggaaaataatgctctctttagaaagcccatgtgaggctgtttaaggtaagacattctgaacctttattccattactgctgcctccatccattcaaaaaggatttgtggaagttggcaaagatgcatacaaaacaaaattaagaaaagaaagtaaggcaaccagtctaaagagaagtaaagggtaaggaaaaatgtattcggtgtccaatgcacaggcaaagaggtccctttcacaatgctagttgtgggtctcgaatttggctgtgaaccacctggcagtggactaaagagggaaacaggaacagtactcacagtttccaaaaccaagggaaatactgctattattgttaataaagtgtgaaaattttttccttcatagattgaccgtgatatagtgaacaatgtctataatatccttacatcaaggtttaatcacctgactaaaagatacccttcctccagcttcaaaaaaacatccttaacttctggtagaagagacatggtaccagaatcaaaggttagctctccaaaatttaggaattttttctatgttatttattagtccttatgttccatcaaagacagaatcattttgaagcatatccagctcaaataaattaatgttcccattttttggaggaaataagtttacatacttaaatatgacctgcataatcactcatctaacagtaaagtatatttttcaacccagaattattttgcccagccaaagtatttttaaaaattgtaggaacaccataaagacatgctcagatatgcactgtctaaaagttttccttcctttctctgaaagctactgaaaaatgtgctccatgaaaataagggagtaaacaaagaaagaggatccaggaaatgggagctagcacaaaaagggaaaaggatgacggtgaaaggaaatcccagtatggcaggcctagggcacagatagtccagcctggggctggtcagaggctccagaagaaatggccccaacaagatgaaacagatgaatagctgctgtggctaaatacgttaaagagaacagcccacacctggggaagagtgtagaactacactagtgatgagtacgctgaaaaccaagcaaacaagagcttttgtcttagaaaagggggtgaatggccgggcacggtggctcacgcctgtaatcccagcactttgggagacgaaggcaggcagattacctgagatcagaagttcgagatcagcctggctaacatggtgaaaccccgtctctactaaatatacaaaattagttgggcgtggtggcacacgcctgtaatcccagctactccagaggctgaggcaggagaatctcttaaacccgggaagcagaggttgcagtgagccgggatcgtgccactgcactccaacctgggcgacagtgagactccgtatcaaaaaaaaaaaaaaaaaaaaaagaaaagaaaagggggtgaatagaaatagatccatttgcttgcacaaggaaacaatggaagcataagaaactaataaagacagcaacttacaggagatggagaataatggagacagtagaactagaatagagtgaggttttttaaagtacactttctatgttgttttaatttctaaaccatgtgaaagtactacctgttcaaaatcaaataaaaataaagttctaagattgttttctgctaacagtgtccagaggctttacttgttcttttgacagcatcaactgctgacccacacttggctttctgtattgcacacatctatagagaattagaggcaaagaggtcacaggatatggctacagccttgaaaataaaatcagtgaagataagagaagtgggagaagcatcttcaatttatcaaagcatgaagtacagccacttgttttctagaaaaaatagtactggctatgtacctacagtataacccatataagtgtatagaaatcagatgtattaacaagttgtttttaatgggggctctatgagaattttgaccatgcagttcttcctcaaattcccctgtgcgttttgaggagtaaggatccctagccactgtccaccaaatgtcagtgtgactcctcagtcactgaggcaataaaaaatgttccctcctccacatttccagaagctcatactcccaactgagaaccactgtgaggaataagtaaaaaaattaaaaattaacatttgtcaatttttttccctatcactgccactaatttttatcagttcattaatttaatgaatctttataacacattcattaagaaatcatgaacaatctgatcttccaaatgcttgggtgttactaaagatagtttgtgccttgagtttgtttttttttttaaccgagctagagaaaatctgaggaatctagaatccctgccagccttcagtcaaagtcctgcttcacaactgcagagtatgcagtttaattttttttaagttcttatatattctctcattgacaaaggctaattacttctcttaagagtcatgtaagctcagcaaggaaaatactattttccccattttcacagatagggagtctaaaggtcagagcagtgaagtgatttttccaagctcataattgacagaacttggagcagaaaccagaacttctggttgtcagtctggcggtttctccactcagctgtgatgtttactctagacagtattttctctatgccaagcctataacacatcagcttgattcaaatctttaacacgatgattataaatttgaaacccagcatcttatttttaaactgacaggtcaactataatggtcctcaaaatggtacactttgaaaatcaataaaggtgactgagggttttacacaggttagcttgtgtggtcttcccaatagttcttctaggtagatacaatcattatccattttacagatgaggaaatgtaggcagagaaaggggtaagcaatgtgttacttaaggccacacactagtaagtaacagtgtggatttgaacgcaagcagtcaaactcaagtcggggaaaactcccagtagatttaactaagaaataaaccccccagaaaaactggcaggtggattgtttagataaacaatgaaatgtctctttagctctgtaaagaaaaccagcaacccctatgtaagtttttgatcaactggtaaaaatgacctcaaaatatagaaacaagcaagtaactgtccctctatcaaactaaataatattttaattgcctaagtagtgggcatttaataaatcatcaattttctattctattaataatatttctgtggaaacaagacaactctcaatcaccaaatctggtaaaaaaaaaaaaatcacaacaaaaatcatacagaggcaacacaccgagttaaacaacagcctggagaaaatagattcattttattcaacttcaaaagtgataagaagttgactccaattattctattccacataggaggttatgatgcttatgaccaatagccaatgcataagactgataattttctagtctaaaatttctacagagcatcccaaaattctattttcaaccaagtttaatctccagaagtaagagtatgatatcttggtaagaaacactatttaatataaaaattcatagtcatgaaataatttagtaagacaccaaaagggtcacagtcttacctcaaaaaccatgtgcatactgaaaagtagccaggttgagggcaagtaagaacttagggaaaagcctgaactatcaaagaaatcatctgtctaagtccccagaagaatcaacctctacagaggtaaaaatggaaagggcgggaggagatacagctataagtaaaactccatgtggcctatattctatgataatgtatgatcaatggtacaatataggtaggtaagcatatatggatctataacaccagaaaaacaaacacatgttgagttaataattagatatctaatgatcaaagaagagctagaagtgaaaaaaaaaaccagagcacctacttaccatgggttcagtggtggtccctgttgccagcacacattccgtaatctcggaatcctgtggctagtccactctactgcctccctagatgatggaactctgatgccatggcacattgcaggagctacctagtcatatcaacagagttacagactcaggaattgagaagaacccagagctcggaggccatgcagcagggcaccctccatattgagagcaaacaccatttggggtttggggtttatttatttatttttttttaagacagggcctcacactgtcacccagactggagtacagtggcacaattatagcttactgtaaccgtgagctcccaggctcaagccatcctcctgcctcagcctcctgagtagccaggactacaggcatgcactaccacaccagttattattatctcttatttttctggtagagacaggatctcactgttgcccaggctggacgtgaagtcctggcctcaggtgatcttcccacctgggcctcccaagttgctgggattacaggcgtgagccacctcacccacccagcaaacacagttttgaaagactttctagtaaagagcccaagaattaactgcccagagaaagaggatgtgtccccatcttacagatggccagtagaggcacccagaagtgtgatattcctgaaatcactgattcagtactgaacatctaagataacacagcgatttgctgacaaagatcacagtagactctgtgagactgtaccttgaagaaagaagggaagaataggggcagagaaggcccctcaggcctgcctggggaagtgggggaatgggagtgaggagaggcagaggggacaggaagaagcccctccagcagtaatcaggggagagaatggtcaagaggagcttgaaggacactgagagctggggactggggtccggtggttctccactggtatgtgggtgaaagtggagaaggaaaagtcgaaggagctgatgagctaaagaaatggcggaaggaagtagaagagaactggggaggccttctgacagaggtcagtgctggaaaaggggaaggtgggcacaagagatgatgacaatcttggtagaaacatcatacagaaaatgcaaacatccatctagatgaccttcagtgatggtaagattctattaaccttccagagttatccgctccaaatttagaaacgttttatttgtaaaatagaaattgccttgttgctttggtccatttcttctcattttaattggaatggggttggaggacagttggttaccactattaaaatgatgtgttttcactgggctcatagctctttaaacagactgagggataaatactctcccagcccctgttctaagttggcagacagacaggaggggccactaagacaacacctaccctctgcaaatcagcaccagacaaacactttagttggacagcagaaattatatctccattttccagaggaacagaaacatctaaaagtttaaatttaatctaacaagtattttgaagttcttgctacatgcaaggccaccctaagtttatttgtgacacgacagcatcttccactatgaatgaaacacacacaagaatctcagagtttcaacaggcgcccatctatctcatcaggctcattcaagaatcagaagtatcatttaacagtccagaaaaaaagacattcaggtgcctcgtggctgcttcccgtcttcaatcccttcagcaatcatggttctgagtcagctttcataacccacaatgacacatctatctgaggcacacattctgagataataatgtccataaatggctgaagataaaagaaaaaaatcataagacagtataatgggaatcataagacagtataatgggactcataacaagatataatttccataaaaaaccattttggtggcagcttcttctaaaaaaggtgatgaaagtaaatataacatctctcacataatgtttatgttctgtaccttgtatagattctatgtctttattaaataaatgaaaagaaaaaaagtccacatagacaaataaaataccacattagggcttttttttcccccgctcaatctggaaaattttgcaaaaaaggatcttttatttatggaagccctgactttcaaatcttatttaataagcttttaggaaatgaaagataccggtggctcatttagccatgaagggaagctgcaacaggagccagggcctagacttgccaaatgaaggtggctggaggaaagggctatccgattcattccgccatgaaggacttttacttagggtcaggtgaccaagattctctatgcaggtcagaagacatcagaaagcaggccgatctggatccaattcagcatctggcatcattgactgcctcggccatgtcacttaatcctcctgagcctcaattccctcaatggtgagataagcttgtttatgggactacccacctcagtaggttgttgtgatgattaaatgaagtgccatgctaaagggcctgatacctaccagacatacaacacaaaccaccctctttcacctcttcttattttccctctggctgaaccccagtggtatggcaagctaagcgtctctaaatatcaggcgcctcaactgcaaactgacaaaggataaagtatgcgaaagctttaaatcgctatgcaaatgttaggagatattgttattagtgccaatcggtacacctcactcgcaactgcacatcagggaataagagtaaaaagcatctctcagggagtttctttctaccccacctgtatactgctaactataaagcatagttcagcccccttcagggacactaatataaaagtgtccctgaggggggatgaactatgttttatagttattttctttttcattttgtgcatttaattaatgcttttatttctgtgctcatactcttgggtaaaatttgagaaaaccagaattggaaatgctaaagacaaatattagcaacaagcaacttgatatttgcatatccttgcaaagatccaaaaggagctgaatatgtggaaaacaggtagtaagataaagaaaaacaagtgttaagaacaaaagttctgtgagtttctctggggtgaaacttgcctaacaatcttcaacacccagcaaagtgtccggcacatggaaggtatttgataaacgatatttacaccatctgtaggaacaacgtgacctcagtctaccactgaccactaataaaaagataagcagaaaaccaaacctgaaaaatgaatattactctagctgatatgtgtttctattgactaatttattgatttttagaatggccatgggtacactacaggggtatatggtcttcaactcccaactatgtaaactctgaattccaactttaaattgttcaaaataaacagaccaaaacaaggcctctataacccccattacctgtattgttgagatgatgagtttgggcagaaacaaagcctggaatgaaacctcattcccgtcctccccagacaccacatacatcacatgggtgtcagagaatcctgtgcatctaatcattttcaattgtcatttcatctaggatgccaaatgttaaataatcaagactaaattttctctctgtctctctccatctttagtgcaagcagtatattatgggttaccatactattcttaatttctaatcatttttagtgtcttttctgccaatttgtaggcttttcctacctatcccagtgtttcttctggcctatgcaacacttgctttgcatgtatattatgccagagaaagggaaatttatattcaccacaattttgtacaaacaagcaaggcaaagttaaataaaaattagaattcagaagagaagcagcaatttatacagggttctttggccctctgccaatcctaaaagaactttgataacatcaaactacagaggtcccagcacctatctgtaaaaagagaaatacacaattctcagtactcaaaagcatcttctggtttgctatgctagaaaacaaaccaccctaaaacttagtggctttaagtagtaattttattatctttcatggttctagtagcttttactttgcagctgaagctggaatgatctgaaggctttttcactcacatgtctggcaccttcctgagaaggctggctgacacctctctccatacagcctttctggatgagtatcttcagcttcctcacagcatggaggtctcagagtaatcagctccttgcatggcagctggtttctcaggatatgaatgaaggctgcagtctctttaagactttgcctgggctgggcgcattggctcacgcctgtaatcccagcactttgggaggcggaggcgggcggatcacaaggtcaggagatcgagaccatcctggctaacacggtgaaaccccgtctctactaaaaatacaaaaaattggccaggcgtggtggcaggagcctgtagtcccagctactcgggaggctgaggcaggagaatggcatgaacccgggaggtggagcttgcagtgagtcgagatcgcgccactgcactccagcctgggcgacagagcaagactccatctcaaaaaaaaaaaaaaaaaaaaaaaaagactttgcctggaaaattggtagagactcatttctgccatattttatatgtcaaatcagtcatcaaacccactcagatgcaaggggaaggaggtatagaccccacttctcaacaggagaattgaattggaagccaccattaatccactacactcagattgccttgcatggtctgcatcacaaacagggctaatggcagaatgagccccagtggatcagatttgtgcacatgtagatgtccactcctgtaaaacatcaataatctttttttttttttttttagagacagggcctcacgctgtgtcacccaggctggagtgcagtggcatgatatagctcattgcagcctcgaatgcctgaggtcaagcaatcctcccaccttagcctctcaaggagctgggactacaggcatataccatcatgcctggctaatttttcattttttaatttttttgtaaagataaggtcttgctctgttgaccaggctggctgagaaatcataatcttaatgttgggagattgaaagtggtgctggtcaactgtgctagttaattatttagtgtgttttcatttcactgctatcttccaagtttggggaatttattagaaaaaattaaaaaagagttgcctttgatcactggcaatcatcaaatatataaatttattgcatgtattttataatgtcatctgggtaaaaaaaaaagctattaatattttcatggaggtgcaacaggtttaattccaaattttggtcaccgaaagacttcatggctcacctttttatactggtcttccaagcggaaatgaatagataattatgcagtcctggacatacagatttaattcctgttgtgaatattcattcagatgagcaggaaaacttcaggttattttaaatcaggatgagaaatcaatactactagtaccaaagaatatatctgcatataaaactgctcattaaagtcaggcaaggaagacatagctcccggaaagccccacttagaaattacaccgaagctgatccccgccagcaacttgttaatgaatatctctggtgttctaggccctagaagaacacacaaaggatggggcgagaagttttccattttagacggtgaccaagccctgtaggaactggttctgtctgaatcctttctttacccattcctgatgactgcttggtggcttttttgccttgggtgcctgctcttatagcaggtcttcaagcctgctgaggggcttcttgagaaacttcaaaccatcctacttgagttgtccttgctctgcaaagtccaaaaacaaggtatggccagtctaataaccctttctcttggagaagaggcagttcgtccctgttcaagagaaggcaggaatgacaggcagacatcaagttctttcttgcttaaccaacattaggcagacagggtccaccccagagcagcagtgtgtgatcactgttgacaggtacacagagaggaagaggtgagcagcagcaacgtggaaactgggttaagaaaaccccagggaaaaaatagatagctaattagagttttcaaattaatgtgcacaaactgaaatgaattttcaaagatgttcctcctttccttgtgccaaaatttaagtctttttctgaggtccagaatgttacagccaacagaacaacttggtgatagaaagcaatcatttttaaaaatcataaaagagattaattgagcccttataatgtgccaggtgagtactgcgactatcagcattttacagatgaggaaaatgagacacaaataactttaataacctgcccaagagcacttagaaagcaagagctaacacccaagtttatactcctaaccaccacacaaagtatagaagaaggagcagggcttttctgactaaacaagactgatatctaagtctaactctgccaattactgtgctagatatgtgactttagtttctaaactttctgagcttcagtttccttgccagcaaaatagggataataccatctaattcttataattggttgctgtgaactctcagaatgtaggttttcaatcaatggtaactatttttttgttatgcagaccagagggaacacagccaagctagcaaaaatgaaacacaagaatgggaaggaaacctggaagcatcaggaacatgcacacctcattttctgccaagcaggcaaactataccttggcgagaatttcctctccagagcctcaactcctctttttaaacacggaatgggcataattctgggagattttgcatatgcagtattcataactcagggaaacaatgtgcattttccttttatttttaactagagatacacaaatacatgataatatcatatgcgcatacatatttttacttacattcaatcttttgcaactctaatgggtccttaaatctgattccaaattaagtccttcagacacggctctgattaaataactagctggtttcagagccatctgaggattttttatgctaataggataaaatccagtctctttggcctaccttcctctacctttcacagtaatttccattctaatgctatcacacacacatatcccaccccatgcctcatcaggaactcttctataaaggacaaggcctctctgcctgcttgtccctgaacataaacatcttgctcattcccacctctgcatctttgcactggccggatcctctcagcatcacccactggctcatttcctccagttcaagtcctaccagtctgttaagaccctgctaaaggacctcctcttccagcagacctcccatgaccaatttggcccccattaatccattttgtttttctactgaattcctacctgtgcagacttttcagtttcatttctacataatttactactatgtaactttccttagagaaaaatcctccctcctcaaggatactatatgcaacttgagagagcacatggttaagagtacaggttcgcagtcaggcagatctgaagtcaaatcccagccttgccatattctagctgtatgacctggaggaagctacttaacttctccaaatcgtagttccttctctgtcaaatgggattataattgtagttatctcacattgtttgaaggggggattcatgcctggtaatatataagtgctcaataatgtcagctataattattatcactacccatttctcacacgtttttaatcccccacagcaccagctatctattaataatctatctacctatccatctatccatccatccacccatttatgttagagactcgatgaatctttaccaattgcctaacttagacgtaccaatccttctcaaatttccacttctccaagaagcacaaagctgtttctactttattaagccagcatcgaaactcaagattccccagatagggtctcacacagagcatgctgatttccaggagctttaaatgggaatgaaaagtgatcattcccttagttcagatatgctggtttgaagaatagctgagtaattcatgaggttctttcaggtgcattgatcagattctgctctttaagaagcattgtaccttgaagtaactatttgtcattccccttccaaatgagagctagataatagactgcatctgtttagcaaaactataacaaaggtctaaatgataataataccttagacctgctggatgcatcatagtttataaagcacgttcatacacatccttcatcgcatgcttccagcagccccaatcagataaccagggggtttatctcagtgtgctaagtgggactgctcaggctggagaaggttcaagagctttcccacaggccagttcattgattcagatcttccaactcctacttcagtgttcattttatggcaccacaggatttaaaactattcgcatatctttacaaagagatacccagctggaaagtgtgtaacccactgctaatttgtgttttggttaaagtatctatagtatcaccttggagatataatgcaaagcaaatctgtcaaatggtatttaatgcagttctatactacctgagactaagtggaagacctcagttgaaactctgtttttaaactagccattttcagtctttcgagcctgttttcctagaagtagagtaggagtacacagcatcagcctgctgggattccttgataccagactcagcctctactgtacttggacagtcttccttggtccagttttccaccagttttctaccaggctcccccttccttactgccctccagttgcccaacccgctgcctggctctttctcagacatacagagtatgtaccatctcagtacctattcatgggtggttctcagtgcatggcctgctccctttccttattcacatttctgcacaaatatcacctcctcagagaggtcctcaaaccatctaatcttattaacaaccccagacgcactctgcaaccactttccctactgtttcatcatagcacttaaccactactagacattttacaaatgtttcatctatttataactggtcttcagcactggaatgtaagatctaggagggcagggctttgtattgctcaccactgtatcatcagcacttgaaaaggtgactgacaataggaagctcccaataagtacctattgcataaaggaatgcagcctataaatttccctgtttaaaatctctacctcttccaatttgaaaagattcttatacatgaagccaaaagaacaaaaacaaatctcacaactaagataaatgcacaaaaaaaattagtgcatggatgggacaaagaacaagtgtacagaacccctaggattggaacagccatgactccaacaactgttacaatagttacatcactggacctaatgccaatcagttgattaaaaaaaaattagctgggcacgatgactcaagcctctaatcccagcactttgggatgtagaggcgggcagatcacctgaggtcaggagtttgaaatcagcctggccaacatggtgaaaccctgtctctactaaaaatacaaaaattagccaggcgtggtggctcatgcctgtaatcccagctactcgggaagctgaggcaggagaatcacttgaacctgggaggcagaggtttagctgagatcacaccactgcactccagcctgggtgacagagcgagactgtctcaaaaaaaaaaaaaaaaaaaaaaaagaaagaaaaagaaagaaaggaagaaaaagaaaaagaaagaaagaaaaaattaatgaccaacattccccttctaccccccaggcaagaggtctctcgttgcctaaggcaatttcatcgcatgcctcagagtaagcaaaaactgacagataaatgtcctaggctatctttttgagaagaaggtccaagttatttcctggatttttgcagatatgacagtaaattggcaactgagggaataacaacctgacatcatgtgcccctaatctgatacaattagagctactcatcatcagccatgaaatgttcttgctaaaaatatgtaatctgaatgtaatcatgaggaaatcatcacatatccggaatgtagggcattctacgagacaactggacaggtctcttcaaaaatgttagtatcgggaagaacaaataagatgtagaggctctactagattaagaaaaaaagactcagttggatcctggattgcagggggaagctagaaaatcgaaaaactagagaaagctgaatatggatggcatagtttacaaaagcttcatcagctacatccatttactctacaatatttaaagccaatgtccaatttatcactattcacccctgcaagtaatcattaagcattttccatatatatcatgtccttctccaatcacatacatctcatcacagtaatatctatatcctgaattcagcagggcttagcctccacagggcatctttaatactaattggaggagacaggctttataaatccttatttacaagatgattatgaaaactatatttcctaggcctgtcctttacgcttctattattctctctctttctttctcttgccaataaagttcttattaaatgctgcttcagccactaaattgtaaattccctggcagtagaaatgatacctggttaatctttgcatttctaagaagcaaacaatggcttacatagagtacatagctcataaatgggttgttgaattttcgaaattactgtactttaatttagaccacataatgactatttatttgcttcaatttttaaatgaccctgaatgtctctgtgctacaaaatgtactgaggcactgtacatctttcagattttggaacttgcattcagttgccaataattttatatatttcatgaaatgtttaacaataaaactactctttgcatctcaaaatatgttttgaagaaattatgaaatcaagatgttctttcaatgtataaaatattcaataagtgactcaataaattagtagcatatcttatttgaaactgagatgccattaagagcatttagtaagctgttttgaatactcttatctatctctgctaacaaaggcttgtttcaccaagtaacttgggaagtcatcccagtatcatgatttatacacctctccccattcatactaaatgcatcttcactaaccctcttcaatgagaacttttatagttacttatttctttagaacttattgaattgattctcgtattgtgaaaggtattataacttatagttataaaaaaaagttaaaaatcatttaacttttgacttctcatctcatgcctagctttttaaatttccatttctatttgtgaatcttgacatctgtaagcctcctggatcatcaggctctgagacagtcacattctactttgctgaaatcagattgctcactgaacttcaataagtatgtttctttaatacttactagcacccttttgtgacaatccccaagcccaccacctcactgggacttcaccccttcctataatcaaagggctttgaaagacaagctttctctaaggctgcatggcatttcccaaagaattaccatgacctagttttgaactccagatagacttcagccagtgggaaacaatatacgaagcatctttatttcagcaactgagcctcattccgaagaactgctccctctctgagaggttaccccagtggaaaatactgcctgagagaaaaagagattacatgtgtggtctgggtccagccatgacccagctgtacaatcctgggaagtgagtcagtctctgaactttgatttcctcatctttaaaattaaacagtgagactaggtcacctctcacttgccttccagttctaagattctataattccatcgagtgttcctatgtggagcagaaaggggaaacataattatcaaatttcaaaaatacggcataaaccctttggtaattcttctgtattctgctacctctacgtattttgagtaccctggcaacttccataaggacttacaaaaccttagagactaaaacgtgggccaaaccgtatgacccagcaattctactcctgagaaatgaaaatgtatgtacacataaaaagttgtacacagatgttcatagcagcattattcataatagcccaaaggtagaaacaacccaaatgtccatcaactgatgaatagataaacaacatttacagtctccacacagtgaaatattatttggtcattaaaaggagtgaaatactcatacatgctactacaaggatgaaccttgaaaacaatctaaatgaaaaaagtcagtcacaagattatatgatttcacttgtatgaaatttccagaacagagaaatctacagggacagaaagtagattagtggttgctttagggtggcgtagggagaatgaggggatgggagatcatagccaaatgtccatcagttgatgaatagataaacaagattggtatatccatacaatggtatattattcagccataaaaaataataaactactaatacctggtaggtattagtctgctagagttaccataacaaaataccacagactgggtggcttaaactacagaactttactgtcttacagtaatctcagatcgtggtccagctagaaatcccagattgaggtccagcagggtcagtttctggtgagggttctctttctggcttgcaaatggtcacctttccactgtgtccccatatggcagagagagagcaagctctttggtgtctcttcttataagtatattaatcctaccagattagggcccaagcttttgattctatttaaccattatcacttcttcaaagggcccgtctccaaatacagtcacactgaaggttagggcttcaacatatgaatttacaggggatacaaacattcattttataacatgtaacaacgtggacaaaacctgaaaacattatggtatgtgaaagaagccagtcacaaagcaccacatattgtataaatctacttagagtaaatgtccataatgggaaaatccgtaaagacagaaagtagattagtgattgtttagggctgggatggggatagagttgaaggaaatgtggaatgatgtttcttttggaggtgacaaaaatgttctaaaattgactgtactgatggttgcacagctctgtgaatatacaaaaatccattgaattgaatacttcaaatgggtgaattgtattctccatcacaagaaaactgtttaaaaaataataaacaaatagacaaggctcaagatgattgcctaaggatgaaaaaacaaagagcttttgaaggaagtcctgggctcagatcccagtgctcccactcattagctgtgtaaccttgggccagtctctgaacctccagttcctttactctgtgacgtggggagagcatggcaattgttctcagttggtgtgaaaatgaaacgaggtaatgcacagtgcccgacaagtatcctaagcacttaataactaatggtcattgttgaatattattagcatttcatcagaagaatagcccatctgttttttgaactgaattgatttcaaagctcaggcactgaatttgaccacaagtttttagtggctactgcagaagtggaagcactcatttttcaatatccaacaacagagtcagtgccacttacctataagcttgctgttctatgaacatgtttgtgactcgagaagaggcatgtcactaaaaccaagatggctttttagcatctttagtcaagggagataccagtgtccaagtgatcaaactatttcatgcccggagctgacagtcaatatttgctgactgatcgacttagccatgcctgacttatgagggtttttatttcaaccgatgtttcattaagtgttggtaagacaggcccaactgtccctgggcctctggagccttttgggatatgcagaagaaacagagttggtccctgcctataggagtttgtattcaagcatctagtcctaaactgatttttaagtttatgtttactttaatgttaccactattccaactctccatgtgaataaacaataaaactgctcagtacatgaaggcaagcagtaaaaaggagtttttttacactcaaggtaggcccacctctccagcacttctgaggcccagttccaatccaaaaccagtggaaagaactctgggccaaatgctgaggacatgagagttctattcccagctataccacagaatagctatgagtgcaagactcctcctttatctgtagagaatatgtggatgcctgaaaccaagaatactactgaaccctatatacacaatttttttcctatactacatacctatggtaaagtttaacttataaattaagcacaatgtgagattagtagcaataactaataataaaatagaacaattataacaatctgccagcatcactactcttgcactttggggccattattaaataaaataagggttactcgaacgcaagcactgcaagactgcaacagtcaatctggtctgacaaccaagagagctactaagtagactaaagggagggcagcatctattgtgtggatacactagacaagggcctgattcacgtcctgggcagacagagtgggacagcttgagatttcatcatgctactcagaacgatggacaatttaaaacttatgaactgtttatttatggaattttccatttaatattttcagatcgtggttgactgtgagtaactgaaactgtggaaaatgaacccacagataagggggactacagtacaaatcctacccttttgtactgcttccatcactaagatatgaaagaccaggttagacagtaaactaagtctctctatcacctagaccaaaaaatgcatattagttctacataaactaagtgcctttgatagttctagttctcactgtaatttaataaactggcacaatgttctaaacaagatgtagaaactgccttccactccctgcagacacacacacacatgcacataccccagaaaatacaaagtgaggtccctgagcctgactggcagaactgacccattgtgataaattcacccatctgaaatgagtcctcttgggaaagagtctaccagcttatcctctagaattcacgcccctctttccatagccccttcatgggcctgtgtataagggagctgtgatccaacttggatacatactttccttctgaagtcatggtaccaccagcccttttgggtgtgggtgcctgtggttgtacactgtagttctcagctatttaaaaatatatattcctgaaatttgttcattctcacctccagctgtactccaaccataagataacatatgaagatgctaacctcggagccaggctggtttgctggataaaaagcagagacattgaataagaagacctagctctgctcctgattagttgtgtaatttttttttttttttttttttttttgagatgaagtctggctctgtcacccaggctggactacaatggcgcaatctcagctcactgcaacctccgcctcctaggttcaagcaattatcctgcctcagcctcccgagtagctgggactacaggtgcgtgacatcaagcctggataatttttgtatttttagtagagacggggtttcaccatgttggccaggctggtctcaaactcctggcctcgtgatctgcccgccttggcctcccaaattgctgagattacaggtgtgacctaccacgcccgaccagttgtgtaaatgagacttaacttttctgtgctttgtctgtaaataaagacaacaaataatattattgtgacactgaattaaataacatgattaatacagaaggaactagcaatgtgtccaccaattacagaacatcctgtaaagtcagtttgactaaaccattggatagatcctttctcaggaaagattaagtctcaggaaacattaattttaatgcactctctggaaatgttaagtaaaatataatatatattaataaagtagtaaaagacatacataaataaaatataaactcccttacacatacttacacacaccacatgtttatacatatgaattcaaaccaaacacactgtttacaaatggccatttatttctgggaattagtaagtccaactgtaaacataaagacaatatttatatggtcaagaaaaccaattcactagcttcagttttaactcaatttattaattttattttttaaactctactttctcaaaatgccttttttgttttgttaatgtattttttaaatattatcaaaatggaaaaaataaacttacttttggaaatcatgcattcagcaaatacctactatgtactggaaactgtgctatgcactgagatacaaagatgaataccatgggaccctaagttagccttgacccttgaagagctcatagtccaataaaactgtgttaaaaacaaatttttcaatcaaccaaacattctcttcattgatacaaaggagttctcattagtgagttctcattagtgctctaacacttcctagcccggtggctttgaacaatggatatcttcagaaccctgggatcttcatctgcacaaatgaaaaagctgaactatgcagcctgttgcatcccttctccagtgaaaatatgtgattctaattgccattttaagcccaggttgaactttccctttttttaactaccttccatggctaaaattacaggtattttagacaatgtgcaaatgagtcaatacgtgacattgtgtcaacatgtgcataggtatttattgcatagctatataaatctgggcaccaaaatctccttaagctgataagcaacttcagcaaagtctcagggtacaaaatcaatgtgcaaaatcacaagcattcttatacaccaataacggacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaaccctaagccaaaagaacaaagctggaggcatcacactacctgacttcaaactatactataaggctacagtaaccaaaacagcatggtactggtaccgaaacagagatacagaccaatggaacagaacagagccctcagaaataatgccacatatctatgactatctgatctttgacaaacctgacaaaaacaagaaatggggaaaggattccctatttaataaatggcgctgggaaaactggctaaccatatgtagaaagctgaaactggaccccttccttacaccttatacaaaaattaattcaagatggattaaagacttaaatgttagaccgaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctataatgaactcaaacaaatttacaagaaaaaacaaacaaccccatcaacaagtgggtgaaggatatgaacagaaacttctcaaaagaagacatttatgcagccaaaagacacatgaaaaaatgctcatcatcacttgccatcagagaaatgcaaatcaaaaccaaaatgagataccatctgacaccagttagaaaggcgatcattaaaaagtcaggaaacaacaggtgctggagaggatgtggagaaataggaacacttttacactgttggtgggactataaactagttcaaccatggtggaagtcggtgtggcaattcctcagggatctagaactagaaataccatttgacccagccatcccattactgggtatatacccaaaggagtataaaacatgctgttataaagacacatgcacacggatgtttattgcggcactattcacaatagcaaaggcttggaatgaacccaaatgtccaacagtgatagactggattgagaaaatgttgcacatatacaccatggaatacaatgcagccataaaaaatgatgagttcatgtcctttgtaggaacatggatgaagctggaaaccatcattctcagcaaactatcgcaaggacaaaaaaccaaacaccgcatgttatcactcataggtgggaattgaacaatgagaacacatggacacaggaaggggaacatcacacactggggactgttgtggggtggggggaggggggagggatagcattaggagatacacctaatgttaaatgacaagttaatgggtgcagcacaccaacatggcacatgtatatatatgtaacaaacctgcacgttgtgcacatgtaccctaaaacttaaagcataataaaaaaaaaaaactgggcacatgttactaaatagagggaatgactacaatcacccaaatcatttaaaaccgaactctttacattaaaattctgagttcgcataaactggtatgttgcatttatatgcactcccattcaatttatgcatgattaatttgcgtgttttggagcaaagaaatgaaattaatacttgtttttaatatacatgtccaaatatcaaaagccacaatttaagccagctgccaaatactgaaagactggtgtacaaactaacaattcttctcagctaaacattagtaatgttataaatagtaacattagttcacagcaacacaaatgccaactttttaacacccctatggctaaatatacagaaaagtatacataattagatagactatctacagatttatttaccatgctatatttattacccattcctgcagagtatttacgtttaactctgtgaagcaaatatccccacaataattttttcctccacattttaaaaatattttactatgaacaatgtggattctatttgtccaaaaaaagggaagagctgggcatggtggctcacgcctgtaatcccagcactttgggaggctgaggagggtggatcacttgaggtcaggggttcaaaaccagcctggccaacatggtgaaaccctgttcctactaaaaatacagaaaagttagccaggcatggtggcagacacctgtaattccagctattcgggagactgaggcaggagaatcccttgaacccgggaagtagaaattgcagtgaggggagatcacgccactgtactacagcctgggtgacagagtgagactctgtcaaaaaaaaaaaaaaaaaggaagaaatgacagcaccatgcatgtaaaaatgcattctttttaaacatcaaaataatcttggacagcgctggagagcatgtggagaaataggaacacttttacactgttggtgggactgtaaactagttcaaccattgtggacgtcagtgtggcgatttctcagggacctagaatgagaaataccgtttgacccagccatcccattactgggtatatacccaaaggaatataaatcatgctgctataaagacacatgcacacatatgtttactgcagcactactcacaatagcaaagacttggaaccaacccaaatgtccaacaatgatagactggattaagaaaatgtggcacatatacaccatggaatacaatgcagccataaaaaatgatgagttcatgtcctttgcagggacatggatgaagctggacaccatcattctcagcaaactatcgcaaggacaaaaaaccaaacaccgcatgttctcactcataggtgggaattgaacaatgagaacactcggacacaggaaggggaacatcacacactggggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataaatatatatatataaaatcatcttggaatgtatacaaaattattttaaacaggaatgagttttattcaggtctaccttgcttcaacctccctcctttttgaactggagccccatcctctccagagtctccagggcttctccactcctgggcacctgtcctttagccccttctcaccacactctgccactgtcaacccgtctttactttcccggtaaggccacagtctcctgaagtccagccttaggcaaaggtgacagaggaaaggagaggttaaggtcgctggagttggagaggtcaatgaagagcgagattcaggtgttgaatggctgcctacctggacaaataccactaaaaaatgatcataaacaaaccaatgagcaaatggaaaacagatgtaagatcgtccaagataagtggaagtgcccagggtcttggtagatcacagacgaaagggatacagaatgataaagcataaaatttgggagctggattaattgatcacaaagacaccatctattgctaacatccttttgttagttgatgtattattctagctgggccgtaaacacatctcaggaatcccactgttaatctatatcttcatcagactgcccagataggtctacttcatacctttcctgccctcctgaaatccccagtcagctcctctccatctcagcagaaaagctggcttccttctttactaagaaaaatcaaggtcatcagaaaaaagatttcctcgcacattctcctttccatctcagctcttatgtttcttctcttcctttcttcctatttgagaaaaatccttcctaacttctaagattaaatcctctgcctttgatccccttttcttaggcatattagattgcctctgtaatctactagcttatacgcttattaaccatgtgcccaatgctcagtttcctcagctgtaaaatggagtataatgcccaccgtgcaaggcagttataagatttaaatacaacaacatattaaagcacctgccacagagcagggtgcataacaaaagtgctattattattaccctctaagccttgtctccctcaatggctatgcctgctttctctcgcattagttaaaaattcacttagtgctacctttctaaaaggcgttttagccactggtactataacaacgaacaaaatcaagggaaagatggctcacccttgtgaagtttacagcctagtgggcagggacaggaataaaatacttaagtcaggtgataagcgccatggagttacaacttataaaagagtgtcctgggaggtctcacttaaaagatgacatgtgaacaaagacccaaaagaggagaaagaccaagcaggtatttggagaagagcactcctacgtgagaggacgctgcagtctcctggagggcttgagcttgaggaatgaggagggtgtgtgtttggtgctgggggctgggggagcaggtcaggtttggcagggccttgtaggttactgcaaggaattcaatacttactctagtgaataataaaagagagggggaccctggtggattttgtgcagtggcattatccaacttaagctttattaggatcactttagacactggatgagaacagactcaaggtcaaggaaggagaagggagatgagttcggagactttcaataattcaggagaaagttgatagttgcatagatgtgagaagtagttggattatggctatatttttcaagaagataaaataccaaaaaggttttctgatggatctaatgatcagtgcagagaaagagaggagtcaaagttactcccaaggactaggcccccagaaaccagaaaaatggagcagctctgtattgagataagcaagactgcagggtcatagctttatctctcccccaccactgcttcctgccccctgtggtcaaccgaccaaaggtcttcctcactttaagaaaagaaagcatgttagctttctgctgtcctaatctctcttaatgctcgacactaaatttcttgaacaattgctctgaatccagggtcttcactttctcaagggctccgcccccacccccaccccattccactacagataactctgcttccaaagagcactcccgcagggcaaccagcatactctagtcatccaggccagtagctgcaattctgtgctgcagcatttggcactgcccattattacctccttcctcaaattctctccatggtgggagatctaacatcctgatttacatgtgatggctgtgatcattccttccatagcctcctctttctctttcattgtctcctcctttttcttctcttctctcaaacacagcatcctctgaattctgtcccttgtccccctgaagctacactgccaagaccttacactcatagtctttatgactgtttatagggtctctagcacccagttcagtgactgagacattgttaattgaacaaatgaatgaatttatcattccatcaagtactgtattcctatatttagtttccacctgtctcccaagctccagctttagatccacaaccacgagctacacattccagttagaagtcatcctgccctacgaagttcaccaagccaaaaccaaacactccatcttaaccatccctccacaaagcaagctgcgttattttaactgccctacttattttaagggtatcatgatccccaaataagaactttcacctcttcaagcctaggatatctactagagtctccctctgccctctacaattcattctacaatgccaccagcttaattttctaaaacactattgtgcccatgtcactcatctaataaataatatttattggctccacataaccttcagaagttaagagagaagaagggagagagagcaaaagaatactagctagggcctgattttggctatttctattttccttttaaatatgttttctactaggtacattttcccctttgaaattcttagattaccccacctccagttccttgcctaggcaaagtacagtacaactcttcaaccagatattaaacatcttcaaaaatccagcccctattagcctgttcaatcttattccctaatacagcaagaatcacttcttcctttcagatggtcttgccatccctcaaacaagcattttacattcttacctccatatcactgcttacacaattccctctctggttgttctctcctccatcccctcttctctactctatgttaattgcccatcaaggtcttgctggaatcctacctcgccccagaagcctttcacatacattctaaccaagagtggtttgcagcattcctcccccgaacaccctgcaatttgctgtccttaccactcctgtgtggctcatcacagtgattctaaaaatgtgatcctgaaagcagcagcagcagcagcatcattttgttaaaatgcaaattttggggacccatcccagacctactgattcagaatctctagaggtagatagagcccacctccctgtaatttcacaagctccccaggtaaggctatgcacgctaaagtttaaaaactagtgacatgaaataccgccttacgttgtttgatcttgtcaactaaataatatgcaaaacaccaaatacggtatttagcatatagctatccctcaagaaacttgagttttgcaatactgtttcaagtagtttcatcgcaatatacatcaagtgaattttacctctacacctaattttaaaaaacaaaagtaaaaacaaaatgcctttacgctaaacaatgaaaatactttgttttttaacgtgaaccaagaaaataagccctgtcatagtggctcatccctgtaatcccaacagtttgggaggctgaggtgggaggatcctttgaggccaggagtttgagaccaacctgggcaacatagggagggtctgtctctcaaaaaataaaacaattagcccggagtggtggtgtggacttgcagtcccagctacttagaaggctgaggtgggaggattgcttgatcccaggaatttgaggttgcagtgaactaagattgtgccactgcattcagccctggcccagagtgacaccttgtctcaaaaaacagacaaaaaaaaaaaaaaagaaatgaaattaatattgttttaatcaagagcttgtttaaaatcatttaatttaatattaaatgaataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttcagaaaggttaaattaattaagcaaagaatcttcttttgtaagaactttcttacaaaagaagagcccaaaatgaaaatgttgtctcctacataaaaaggaaaataatgattaacataaaaaggtcttggaatagtataatatgctccatttatcccccatatcaacaaactttttcttcatgtctattgcaaacagaatacagtggtagctgctatgatagatcttgacgtatttttatatatttagcgtctttagagttttattgccaaaatgtccagggttccatacaagtacattctttttaatataattttctaataaacagaaatactggagagaaatatgccaaaatattatcagggattcctctgataattcctctgagtgaagattttacatgttctttttactctctatttactgttcttgtaatattcaatttttttaatgagcctacattaagttttaaaatctaaaaataattttaggaccatatttttgttttatgcatgcattagtacagtaacttacttctccacttaggaggatactgcttttgcgtcttttttttcatatatcagtttgtttaatccacacaacaaccctatgaaattggtaaaatcattattcccattttacagataggaaaactgagtcacagagaaatttagtacattctacacagaattcaaacacatgaagattaacattagagtttgctcaagtcacccaccaaaaggctgccacccaggctggcaacttacatcctgccttttggcaaatcccaagactagttaattacctctttttgagaatgcatacacagaaacacaacaataagcctgtgtgacactgggaaatgattgattttccttattttgtattgtatcttgacaactcagaagaaaacatgcaaaacgtaatatataaaaattttagtatgcatttttaatagtgtttccaaaccaaaagaactctaagagaagatggcctccttaagacaagaggcaatagccaaaagagaagaaaagattgaaatgaggacacaaatgaaaagaaagaatacaaggaagcctaagatgcaagaggaaagctggaggcaatacagaacacaatcgacttgtggaaaataatacctatgctgtgaaagacaaacatgatcacaaccagatgcaatttcaaaagacggatacaaaaataaataaggaaaaggtgatagagagggaacatacagcacagagatccaaactaagtaggaagaaattcaatagtaaggaacagaaccaaaaataaaaatagtaaagataaatattcacatgtggacaaaaacctgctcccaggagcaaaactacagtgagtactaagcaaaataactgaaaacaaaccctatatctatgcctaaaaaagtaatttccattattttcccaaactcatagcactaaccagacggaaaatcaggttaactacaaagtaatagatatcaaattagccctaagcctctctttcacaatattaaacaccattagcctatgaaccatctaagtttggtagcaaaagtttatgataaaatccttgtattccctgacaaattattgttcatttaaaaaaggcaaaagaaacattttaagcaatgtgaagcctcataaaacactgcacgtgtataacattctcataaaaatctattccaagtatacattccagctaagtgaataaaaactcaaaataaagaactcaatataatagagcaggaaatgcctaatttcatgtaatgaccaatttaatgcaaaaggctaaaagcatccttgaaaaacaatgagttgtacttaatatcttcacattttaatttaaaacaaaaaataagaagcatataatattaaattgatatcagataatataatgtatttttaatctatagcatcaaattgaattaacaaacactggaaggatgaggtcagtgtaggagaaataaaatttaacttgactcttttttatgtaatggggacattaaaggattccttttttaattaatttgcataattagagaactacaggtttaagtatatattcaaattggatttttgaaaacagtctatatagaaaaacaaagaaaacactaaagaaagtagaataaataaaatgagaagagatcaaacacatcatttatggctgtaaaaccaaatggtttaaattcctcctttaaaagaaacctcttacattgggttcaaaaagtaaatcttactatatatgctgctttcaagtgatacagcaaaaacaaatcaagacaaattatagaaagaaaaggaaaatcatacataattgagcaaacacaaagtaaaacaaacaaaacaccttatgaaaccagatgtaattcttaggaaaagtcattacctgaaacagagtgcttatattaataaaaatcaaaatctactgtgtataactgttaaaacttttatgcggcaaatattgcatcacagacacagaacacacacacagacatacacacacatgcacatacacgtgtgcaacaaaaacacaaattataacagcagattaaaaagctattcttatctgatatttccaaataaaatttaaaataattttttcagatcctaaaacaaattcctgcttgatatttttattgaaattccatattaatatgggaataatattactaaattttcctattcagaaacatgagatatttttgcattaattcaggcctttagtatgtcccttgttaggttttaattttttcttcatataagtcctgcagatttcttattacattaatttctagatattttacacttattattattaagaatatctgttttcttttctttttccttttttttttttttttttttttttttgagacagagtctcactctgacacccaggctggagtgcagaagcatgagctcagctcgctacaaccaccacctcctgggttcaagtgattcttgtacctcagcctccctagtagctgggattataggtgcccagctaattattttgtatttttagtagaggcagggttttgccatattggccagactggtctcgaactcctgacctcaggcgatctgcctgccttggcctcccaaagtgctgggattacaggtgtgagccaccatgcctggccaagggtatcttttttcaaatatattttgtaattgattgtttttcttggctcacaaaaatactattgatttgggtatatttattttgtatccagccacattgctgaattgttattgttctaatatatctttagttgattctctaagtttttgaggtatcatctgtaaatgatgacaaggttgtccctgtcatcttgtaactcttttttacttatttatttatttatttatttattttttttgagacaaagtcttgctctgttgcccaggctggaatacagtggtaccagcatagctcactgcagcctcaaactcctgggctcaagcaatcttcctacctcagcctcctgagaagctaagactacaggtgcataccactatatctggttaattttttaaaattgtttttagagacagggtctttctatgttgcccaggctggtcttgaactcctggcctcaagccatcctcccaccttggcctcccaaaacactggaattacagacatgagccactgtgcctggccctcatcctcttataattcttgtttcttttatgtcttgcctttattcaatggctaacatttccattacattatatattattattggttattatctgattcctgacaccttgatatcatccctcactttaaaaagaacatgcattaattaggatgtttgcaactgcaagtaaaaaaaaacacacaactgagagtggcttaaacaatgtggaaattgtattatctatataatatgaagactggagtcaggccagttccagggttgattaattcagatgctcaataatgtagggacctgatacgtttattctgtgattctcctggctttcccctcatggttgtcagatggctggagcaaacctaagtatcacagtctttagataatatccaagtccaggatagggaagatatctttttacatatttacttgtaaaagaaaggaaagccttcccaggaacccccagtgaggcttcctctggccttcttattggacaggttgtgttgcatgacttgcttaagccaatcatcaacaaaaagaatggaatcccaatgactggcttaatctattctacctcccccatgctggggaagtggaggtcaacttcctctgagaatgtggaaaggtaaacaccaaaacacatccagagctctgtgagaaagaaaaaggatggggatgactgccgggtagggaaccaacagtgtgcaccacagagagtctctggtgtttaaaggataggtacagggatgactattggttttagacatattatcaagttaagaaagaatgtccttaatcctagtctattaaaaatagtttttgctttgttttttaatcaaaaataactgctaagttgtaccccatacctttttgacatccattgaaatgatcccataattaatgtcctttggtctactaatatgttgtattaatagacttcctaagacagaaataagggggcttacatagcattttctgtgttttcagttccatactgttaattagcaatttttagggtttttcatacaaagcaagaaacacacattattgcttattaataaataatacttcacatataaaaagtttccagatcctaagccagaaaaattgaagagggagaaatgaatcagagggtgacaggcaagaaagacagacagaacaactcagacatgaagtgatatggcttgttctggagtgggggcagtagggcaggaaagcatggaaggaacacaaagcttacttctaagacacaacacatgcagacttaatctatatcaatattttacatcaatggcattctcatcatagcattgggaatcactgagaattgctttaagttatttcagctccatgaaactcccactcctgaccttccctccatctggtccacttccctccatcttccccactcctatacagctagccatctaccctggtgctctgacaatactctttatctatttttacatctgtttttaccactacactttgaacttcttggaggcagaacctaataccttgtaaacctacatatacccagttgcttgcactgcaccagattcagagtaggctctcaaattgtttgcaagagtgatgctgatgttgaatgtattgaacatttattgtgtatttgcaacatggcaggcactgtcataaatacttaacataaaatatgtctttttaattccagcaatagtcctatgtgtactgttattgttacctccatttcataggtgtagaaaagtgtagggattttacataacttgtcacaagctgcaaagctagtaagctatagcaccaagattcaaatccagagagtccaacccctgatgtaatcgtaagtcattttccttcctgtgactttgaaaacaaatgagataagccagaagctcacaaatgagcccaaattatttcatggtcaccttttatacacgttactctctgaggtgccaaaaacgttctggctaaatgctctgccaaggtgtcatctggggaatcctaaccagacactagaggctatcatcattcatttacatgccttgattttcaaaagactgagaacaggttgaagatttgaacattgcagcacaaatctgcatcaaacagacagtgtatctacctttcatccccatccccagcctcacacagagccagtgcatttgcccccttggatcatttggcgaggctgtcaagaaccttaacacccctcaaaaagaatgaaatcaagcacagcggcatctgtgccagttcctctctttttttattactgcccccaaagcctataaaagcttggaatctattaattctttctttatagctggaatgtctactcattattatctgagaaaggaagagtcaatttaatacatttgatttcaaagattctatccagtgaagtcatagttcattgcagtcatatcagctgattactgtaaagtgcaacagtctgcatttgtaaaggaaaaaagcacccaagcttagtaggaggtacacagtagagaacgtgggagacatcgggatagcatttgctgctgaactgcattttgcagacctgaccaccccttccactttgctctgttccaggaatgccatttaactgtcatgggccttatccccctatagctgtaggataaccacaagagccagtgagcactcactaaagctaatcaatatttagaagctaaaaatgaaacgaagaaacacacaaatgcaagcataggcaggggaggcttttaccctgtgcctccaagacctatgtctaagctaatacatgcaactgcttctgggatttatggctgcatttattcaaaccctgtagcctctgaagaacagctcatcctctccttccatattagattggaccagccagaggcaggcccttctctgccaacagtcagggaggtgagagtaaatctgccaccatgtagattccatcattctcaactcctatcaggtaactgaaatccacctataatctgtcacccatgccaaggccatgtttgaacttcatttgatgccctgtgttagaaagaatctttcttgctcacatgcttcttaaaagcagaattagatggctccagatgacttaaacaaaaatctgagggcctacaatgtgccactaatgacaggtgctgaggaaatccggggagttgataaccagctaatcagctagctagctatccacgccatgaggcggcaaaatgtcttttcccatactttcctgttagccactggggaagctgccccacagacagtgctttttagagtgcatagagcagacatgggaatataactgctgcacctgcacagtgacttgtcgccaataaaaattcacctgtgtctcatttattgagcctgtacttataaagaggtttatagtctgttgtcttaatgaaccactttaaagtctaaaggggagatagaagagcaatgagtagaggccatttcaccatctcagggccctctcagtttcttccccttgcatagcacctaggaggtttctaacaatgcaagcattaagacccacagctgcctaggacacaggtctttccatttcccaggggtcctgcactttgttaaggtttggtttcccagaatcacaatccctcctcttaaaggctaaaaacacatgaaattgtattttcacaactgcatagcaagtcgcctgtccactcagttatagtggggatgcaggatccaaacacgatgactcccagaagacacgtcctggtgaattacgtgttaggcacactgcagaatgcaaatgtaaacaagtcacttgagaaagtgtcttaagttcctgcccttaagaagcttataatttaaatacaccaatggcttgtggacaaatcattctgaagcaaaacagagatgcaggtgataaaaagtgtgaacagagcaaggcagaaaaacaaaagtaaggattaacattaaccaggggacctagatgatgaaccaaacctccctgatatgtttttcataagaaagtgtcttagtaacaggggttttgtggctcgatcaggttaacaaaaggaagagtgtgtgggtttccagccctgtccaaccaccacttgtggtgggatcagaatttggactccacgctccaggttcaaccccagcctcattccaaccctgtcaagcacatttctaatcaaagtttcagagtcctatgtccctccaaaatcagaagtacagttccccagagagcagacagtagttctaccattagaaaagcattcccactatttatttagaaaatgggaagcagcaatagcacaatgcttacatttcatgttttaaaatcggactagccaggcacagtggctcacgcctgtaatcccagcactttgggaggccgaggcaggcggatcacaaggtcaggagatcgaaaccatcctggctaacatggtgaaaccctgtctctactaaaaattcaaaaaattagctgggcatggtggtggatgcctatagtcccagctacttgggaggctgaggcaggagaatggcatgaacccgggaggcggagcttgcagtgagctgagatggtgccactgcactccagcctgggtgacagagcaagactctgtctcaaaaaaaaaaaaagaaaaagaaaaaaaattggaccaaactaggttcaaaaactggctccatcattttcaataaatcacttaacctaagcctcactttccacatctataaaattagaatagtatatatcacaagatgtggctgcattaataagactagacttttattaaaataattaacccagtgcttgacacgtggccagtggtcacaaagtatattagctataaatattggtattaaattttgttctttctcatctcccactgcttcaatcgactagcctaaatgcatgtgtattactattattattatataaattacactccagatcagtgtcaggtacatccacatgttggtgtgacctgagactctatcctagccacatttcagtatagttcttggaactgcaaagcttaggaccaaatcctggaccacaaattcctcgctgaaagtcttgccctaaccaaggccagcatgtgccactggcctgtgccacccacccacctggccctcactcaacacctagcacacacagccctcagaagctcagcatgtgctcagtttccactggtttcatgaacattctactcttgtctcccagctgctccgagggaagggccatactctccccattactcaacctcactgtggcacatggtagaagcctgcacagttttcctgtacataatatgacagtgtccatgatttttctctccctctgtttttatgatagccaagaccatgctaggctgggcgaatgaccacaatgattactggagctgagcctccacccagttctgcagactcttaagccctcttcctttctccacatttcctagagggtattctcaaggccatggtggctactgcagtttccagcaactcattcctccttgattactgcccctttccttccctcgccatcatagtaatggtgagtaacagtaacagtaaacataggaacatttttctactctattctaattttttttcaaaatctgattgcaacccattaaactcactccacaacccattacaatttgaaaaacacctggtatctgtgattccaggaagatgacatgctaaaaggagctctgatcatttgagaaaaggaattccccaactttgtgggaacaaaagagctgagctctaggggtaacagtggaggaaataaagtgtatggaggtggaatggggtggtagttactgatactgtagaaaaatagggaatggttagatcatagaaggtcttgctaagttaaggagtttagcctatgctgtaagtcacgagcaggcattcatttcattaataaatggatacaaggatacacaaaacatagcttgcctttgtggagcttatagtctcttctgcaggaagagggtgtggagggagacaaccaaataatttgttaacaaatgaacaaatggcacattatgataggggcttgggaagagtttcaggcagcaggaacagtgtgcataacagcatagaggtgagaaaagcatggaacattaagaaaacagaaagagttagtaaggaatggttttagacaggaatagctctcccagtcctggccccaaagtcctttctctacaggaggaataagttatttgagctaccttatcttgaaggaaatgattatcgttatgtttgtaaaatatgacaagcgcttcagaataaagaatgacacgaaaatacgtagaaagcagaagataggatcagagaacccatctatctctccaggtgttgaagagatggccttcctagaaatatcacagagacctgactaggaaatttgccttcacggtgtgtggagctggtcaactatgaagcagtgtctcaggcatattatactttaacacctttattgaggtacttacataccataaaattcactcaggttaccaccatccaatattgaagcattttcatcacccaaaaagatccctccggcccatttacaggcactccctgttttcctctccaccctagccaaccagtaatctactttctacctccgtagatttgcattttctagacatttcatatatacagaatcatacaatatgcaatcattgtgtctggcttctttcacttagcataacattttgaggttcatgcatgctgcagcctgattcagtacttccttcatttttattgcctaatagtattctattgtatgaaaacactacactttgtttacctatccatcagttgatagacatttgggtggtttccatttttgggccactgtgaatgatgctcctcatgaacactcctgtacaagtttctgtgtggacctatgttttcatttctcttgggtacatacgcagaagtggacttgctaggtcgtgtagtaagtttaactttttcagaaatagccaaactgtttttcaaagtggctgagttatttcatagacccaccggcaatgtatgagagttccagtttctgcatattcttaggtatatttttaaattcagatttacatgtattgtggaggaagcatcccctggataaaggtttgactttatcaagtctgtgaagtgcagagttcacatgatctcacaacttatgcacattccaagtttcacttaaatgtacttaaaaaattttgagagctgtccatttgaaaacatggttgaaataattcagtataaaaatgcgatactaaacaaccaagtaaatataatgatcatagaaattttaaccagaatatttgtcaaaggggagttattaaggaaccatgcaactcaaataaaaatgttccttgcaaactaaacaaaatctccacagggacaaaatcctgattgtgaatcctgcaaaccagcagcaacttatagaaggcagcagccacacggaggaaacaggaaagaaggacaggggattatttttttaaatctgatgcaacttgcattgtatcaagtgatgagatacaagagaccttgcttccagaaaagaaaagaaacagacctggcctcaaagggacagagaacttaatagtcacaggaatgtccctgctgctttgaatacccccaggtactctttgcaaacatacacactaattaaagggggttgggggactgaactggcaagagctttggttcagagatcacagagggacacccagccttcaaaccccttcaacagactctttcaatctagaaagcaaaccctgtatctggggctcggatctctgtatctctctaagatttattttaagtatcatacatatttcactgaatgtctacgatttcctctcttcatagagaggcttcctcctgaagaaggaccctttttgtttccagtgatgaggacctataataattatccactggcactttttctggtgcaatcagtgaaatggaggtttaggtacccagctggtcaggttccagcagatttcccatgctaattttcagtcactcaaagaaaacaaaggaaaaactaagattggtttaccatgattttaaagaaatactgttcctcttccctttccccctcccccaaaatgtgtaaacttctatatttcacacttttacatctgttcttctcccaaaataaaagctgtttatattcaagaaatgatggctacaataccagcacaagttacatctttaaaatactcccagagagaatatacatattgttcagacaacagagtgtctgtgcaatgttctttccctgaatagcatctgggtattggctctagaaagcactacagcgctttatttgtttatttgtttgcatggaaagaaaactgagtactctctaactggtgctggagctaccaatttaaagaagacagaagaagcagaggccttttaggaagagcaaatgcttagttttgactctgtcaaccattccagagtaagacaccagcaacagaaccacctggttccactgctacccagagtatccatgctctgaaagtcttggagctcaattgaaaaatcgcagcactcccaaactcaaagggccctttcaaccacgccaattgcaacatatattatctcaagcgttggaggaatcagataaacaggctgtgaaaaagccatttcaaatttgtagctttcttagacagagtctatgatttcaccaccactagaaaggaaactgctccaaacttagttccagacggaagttttcaaatgatgtcattcattgtcccatctagagcagttagtattcccgatttaaaggcttgaacagggcccagcacactggctcctacctgtaatcccagcacttttgggaggctgagcccaagagtttgagaccacgctgggcaacatagggagaccccccatctctacaaaaaaaaaaaatttcaaaaaattagctgggtgtggtagcacacacctgtagtcccagctcaagaggctgaagtgggaggatcacttgtacccagaagtttgaggctacagtgagccatgattgagccactgcactccagcctgggcaacagagcaagaccctgcctcaaaaaataaaataaaaataaaatgcttgaacaattccctgatactttaatgatattaacacctcttctgagaaaactggagctatccctctaagtgtcaatactgggaaaaacctaataatctttaaccaggtattttttatatctagtctgatgatgattgtctaaccatcggtttttccttcaaaatagttcttctatgaggggaggtcttcaaatttacatttttaaaagcattttccccagcaatgagtataaaattttcatgcacgctcactatcagttgtatataaagttgctttaacaaccatacttgccatcaacttttcctccatataaacagacatgcaatataagcaatgtgcttatctaagaactgtggattaaatagcaacatgggacacttttgtggctaggtaagagatgcttacaagttgttgttacaaagaaagtctgtgggatttcccagtaaggaaatcttcaacctgctgtctagattccaaatatacattccatttcccaggtctcaaaaaataaataactcgaagattttaggcttctaacagaagtagggctgaaagaatttgtgaatatggattctttctttcagtttccaagcaaatgtcagcacctcctggggcttcaaactcaatccctacaggcctatagggaaaaacaggaaatcgacatcagaaggatgcatcttgttgatcaagggagtggggcttttctgcaccttgaataaacttgctaaaaaaaaaaaaaaaaagaaaaagacatgtcaatgcaaagaacaatgcaaagtacagaattatcaattgaaagttgtagacttttcaatttcaagtatctttgagtcttacaaacaattcaaatgcaaatattagtaaaaaaattttaacttccatactcctaagaatgtgtactgtccacaatttctctgaggtcatatgccttatgaaaaagttgcacttaccataaataatttactatttcctattctgcaacattttcaggcatacccaaatttccatgaatatattttgcttttcttttttattttattttattttattgagatatggtctcgccatgttgcccaggctgatttcacactcctgggctcaagtgaagcttccaccttggcctcccaaagtgctgggattacaggcatgagccaccatgcccagccaaggaaactatcttttaaacatttaggccagtggttctcagactcccacatgcttctgaattactaggagggcttcttaacgcaaaagttgctggtccccatcctaagagtttctgattcaatagttgagcgagcccaggcatggtggctcacgcctgtaatcctagcactttgagaggctgaggcaggcagatcccttgagcttaggaatccgagatcacgtaggaaagcccttctctataaaaaatacaaaaatcagtcaggtatggtggcacatgcctgtagtacttgctaccccaggagctgagatgagagaatcacctgagaaccggaggtcgaagctgcagtgagctgagatcgcaccactggactccagcctgggtgacagagtgagaccctgtctccaaaaaaaaaaaaaaaaagttgagagaggcagggcctaacagaggatcctgaagctgctggtccaaggatcccactttgagaactgctgacttagggagttaaactgtcaactagcttttagaaaatcacaacatgcaggataacatttactgagaatctaccaactgcagaactctctactacctactgagtaagccgcacaggtccttgctccaaacaccatctaaattggcaacacagggtatacgtgcgaggggacaatacacagacacatatccaaaacagcaagaagtagttaatacagtcaaactaaagatgtttcatttctccagtgcatttctttatgatgtatcctacggtgcagttaaatctattactctcagatggacattactaaaccacaatgcgtagccattcttccttgcactatgccacttcatttcacttactaatggcagtttcatctgaagccagggcatgaaatgtagagagggacctcattttaaagcttatttatgttattcgtgttgtagcaactgtaaggatcagtgtgatgatcaacactcagatttcagtgataagttatcaagcagagtcatcgagtgcagatatgatctaattctgccatcaggctgaactgaaatgcacaaaaacagtccaacagaatctgaactctaactttcccatcattgtataggtttttaaagcatagctagcaccaactttcaaatgcatacttttctcatgaccctgtcctgagtttaagtgcatttgtatccagattataatcagagagggtatttaattagataatgtttgcaagtactttgaagatataaagtgctctataaatgctaaatattattattattgtttaaatacagtttgcaattactgcttacaacctgttccacccaccacactgctatcatttgattacaggcagctttaaaaaaaatacctagaggtagaaatgatgaaaccatattcatgtgaagccctggatttttaccctagacataaataatttataggcattttaaatggaggattaggttataaactgtagtaaatcaagaaaattgccctctgcaagaccaactaccataaagttgtgtcaattttaatagtttcttacttataaaccaggttgaaagtagattatagtccagaatacggagctttttactctggtggtttcctgttctatcttctattttctccattagaatcttaaaatatctacctatgtgaaaaactgaaagcacaacttaagattttgattttagcaattgtctggcagattaaggcttgagaatagtctctattctatcatggccgtagctcaccttgctatcttctatgatcatcacagagtcagctgtctccaattcttaaaaaactgaaacctttgagcctgattccacacatcctccaaacacacttgctggataattttccagaaagaatgacagtttaaatgtaaacaagccaagctcagtggctcacgccggtaatcccagcactttgggaagctgaggcgggcggatcacctgaggtcaggggtttgagaccagcctggccaacacagttaaaccttatctctactaaaaatacaaaaattagttgggcgtggtggcgagcgcctgtaatcccagctactcaggaggctgaggcgggagaatcgcctgaacccaggaggcagaggttgcagtgagcagagatcgccccactgcactccagcctgggtaacagagctagactccatctcaaacaaacaaataaataaataaataaacaaacaaacatcccctagatacactccacaagaatgtcactgttaatccccaaatagctaccatattaggtttttaaggttttaggcaagaaaaaaaaaaaaacacgttataatctgacattggtcatcttacaaaacaaagttacaaggaagaaataccttggaaatagctcttaaaacaccactatgctcatgaaagacaacttgtgccctaaaccaaaggcttctgggaagtctgtgagcctcagggtgataatacaacagataattctgatgtcatgacaaggtccataaatcaaatgatggctatgtgagtcactattggcagtggctttgggccagtcagtcgtaagctcagccacttagtagctctacgatctttggtaaactaattgatttttcagagtcttatgtgttcatttataaatgctacacacctacagcacaagaaattggaagccaatctggcaatatctagagccttagagatcattcatacactttcattctaaattcaatttctaaggagttatcctaaggaaacagagatgcacacaaagacttatatataaggatgtttattgaagcactatttatcagttggaaagttagaaataacctcaagcttcatcaacaggaactggttaaatatattatgatccatctccacaacaaaatgctaagcagtctaaaaacatgattagaaagttgagcactgactgaatattttattacacgttaaattttttaggcatgataatactattatggttatgtattttttaagtacacaaactactgaaatatttataaatgaaataatatgctactttaaaataatatgggggagaaggtgggtaggagtacagatgaaacaggattcattatgggggataattgttcagtagagagattattaacccttttatctactttttaataagagttttattgagctttaattcacattccataagacttactcttttgaagtgtacaagtgacttttagtatgtttcacagagttgtacaaacatctgcactatctaatttgggacgttagcagtcactccctgccagcaagcattagtctaccttctatctctatggatttgcttattccagacattttatataaatggaatcatacaaccatgtgtcttctcgtgtttggcttttttcacatagcataatgttcatccatgttgcagtgtgtatcagcacttccttttattgtagaataaatattccattgtaaggatatactatgctacattttgtttattcattcattggttgatggacacttgggttgtctcctatttgaggttactataaatattcatgtacacttttttttttttttttttgcatgaatacgtccttagttctcttgggcatatacttaggagtgaaattcctgggtcacatggtaactctgtatttagcattttgagaaactgtcaaactgttttccaaaatggctgtaccattttacattcctatcagtaatataggagcattccaatattctgtctacttattattattatactttgagttccgggatacatgtacagaacgtgcaggtttgttacataggtatacatgtgccatggtggtttgctgcacccatcaacccatcatatacattaggtatttctcctaatgctatccctcccctagccccccatttactgacaagccccggtgtgtgttattcccctccctgtgtacatatgttctcattgttcaactcccacttatgagtaagaacatacagtgtttggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacaccgtcttccacaatggttgaactaatttacactcccaacagtgtaaaagcgttcctatttctccatgtcctccccagcatctgttgtttcctgtaatctgtctaccttttaagtttaaattccccatgaaaaagagttttaaaagttatgccatagaaaaagattaatagcatgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttattttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtaacctttattttcaacatctgaagcattgctacttatctatattgattaacttagctgagttctcctctaccatctaattagatttggtttcttcacagtggagcacaggctatcttcagtgtgttccgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctacctacaaaagaggtaaattggatcaccaatcaccaagccctaggcagacagatagataagtagatatatagacaaagatatgcaaacacaatccccctttacttttcattttagccttaacatggttttatggctttatcctatttatgccttttatcagaaggtgccacaacttactttttggaggtatgaggtgtaataaataaataagatcccttttaaatgaatgaattaattgcattcacacaattgatatttattcaatcaacatttatcatgtgccagacacagttcaaagcaccaggaatgtggtgctgaacatgcaggcaagatccctattctcacaaaacttattaggctccagttgggacagccagatttttaaaaaattcagatagtcacgactgccttaaagataataaagcactgaattggacagtttcagggtggaagggagtgttactttacagatatattgcaaagaaagcctctctgtttagtagggagcctctaagagggccctcagtgacttctgccttctggtgttagttaatattcttgtgtagtccccttcgaaatgaatagggctgacttgggtagccaacagggtattgcagaaatgatggtgtgtgatttccaaggctaggtcataaaagacatagtggcttctgctctgctttcttgattcctctatctggtaaaagtgggcacgatgttatgaggatgctcaagcaaccaatggagccacctacgtggggaggaactgaggcctcctgccaacatccagcaccacataagtaaatcatcttggaaagagatcctccagctccagtcaagccttcagaagatagctcaccttgccaaaatcttcctgcaacctcaggagatacctcatgctaaaaccacccaggtaagccacttctgaattcctggcccacagaaactgtgagatataataaatggttattgttgtttaggccactaagcttgagggtagtctgctatgcagatacataagtaataatacaggcagcatctcaccttagacctaaataataagatggagccctccatgtgaaatttctgacacggagaactacaagaatgagcttggcatattcacaaaacagaaaaaaatcagtgtggctagagtgtagtaaaagacaagtgcaggctctcttctccatccaaccatgggtgtagaaaccatgccaatgttgtcttcagctcagccccagcaactagtagcacccaataatcaggtactgaatgaatatatacacaaacaaataaatgaatgaatgctggataccatgtgcatttcttcccctacagttaatcacatttcacagaatcacagaatactgggcctgaatttaccctgcacccaaacttgcaccttctaatacactaatcaaacaaatgtttgtaacatatgcaatgtattgttaaagtctacaaatttcctacttgatgcatactgccaaggttctaatttcactaactagagagacagcactttaaaatctagggttacttcagagtctaaatccgggtatccagcagcaacactgtaagggagtacccagcggaagtcacagtcagcccttcgtcctatcactcggtcttcaaaaactagaacaacactttaaattataaatcagaatctgacagctggaaaaaaatagctcatttaaaaattagaaagggatgttacgttcagtggcaattcccagctcattgaggtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccactcatcttacatgtgacaaaactgaagcttagagggcaaggtgtcagagccagctttatgacgctgggctctaactcccagctgtgtgcctcattaaacctcaccatctcccaaactctctctacccgctcactgccagctctgtcaagataaaaactcaacgttgtcttccagtgggccaccccagaagcacaccctttcccgcccatctattactgtttaatcaaaacagcagtcataagtattatccgattgttgaaataattgaaacacactccaaacacacacacacacacacacacacacacacacacacacacacatacgccttgcaattctaacccatggtattttaaatctctcaaaacttagaataagacaatggagagaacactttccttggcagaaaaattctagaaataggaatacctacccaggaccaggcatagtatttctcgtaattggtgcccccggaattgtactctatgtaattagcatccactggaattgtactctacataaaaagtgtccccaggagtcatgcaacctagactataatgtaattcatgatccctgaaattgtgccatggtcagcaacaggccccacctttctgaggtttctatactctctctacatagcaccacctccagcccttctaaaagggttgcacagtatatattttgttaattcaaaatttatttgttgaacgaacgcctgctgtgtaaagaaaactggtgaggatccctaagaaaatcaaacgttgcctctaaaaaggaattgtctagtagtgaatataatccaagacagaaagttctgagtgttatgaaagaggtgtgaggtcagttctgagacagtctatgagtgggagggacaacttgagagaaatcagagacttctgtggaaaaggtggtctgcgaatgttcagcgttggggcagtaggtacagaaaggagactaagacagagcgccccctacagagcatccatgggggaatgaaattgttccctgccgcaatgggggagtggtcgtcaaaactgcagagctcggtgggaggcccctctgaattgccgctggtcttaacatgctaaagagtttagttttcagtctgtagactaaggagacagagaaggccttgaataaaaacaaccagattgaaactgtgcgtttggaagactcacgtggctacagtgtacgagaaaccagtcagaagaaggctggtggtagagacacaggaggaggggaggtcctgttgcgggtgttgcccaggggacagtaactacagcacttgcagggaacagtggagacaaggggacccatatgataaacattaagggaagaattttaagttggggtgatataaaatgtgttttgagaaactgagggcacccccatgagacaaccaggacatgtaaaaaagagtggatagaatcatgtttctctaaagggaaataagcttccaaccagactggaaggaatcacaagcggaattcatccaacattttctacttaagtcctccctctctctccactagagaccttatatttatatgtgcagaataacatttcattcaaaaaatatcattaagattttcttagaattctcagcacactgctaacaaaccagtttaggccctgttctcagagagctacttcccccacagaaatgtaagaatcaatttgacattaaagcatctttcagactcaagttactccagattctatcaggaagggaatcagagactggttgtgctcagctgggcatggcggccatgattcaatcacaggagcgcctggctgggtggactttagaaccactatcactgagagaaggaatggcgtcgaaacaagaagggcacggaagattaattccagggcagagacacagaaagaagaaaggccgaacgggcaagactcgaaattataagatatcaaagagttttacagataagggggaaaaaaggaatatttcctgaaagaaatgtactgggtactctctcatcaacaaaatattacatgacctcctaagtagataattatgcaaacagcaaaccatgacttacactggcttttgtactaaagattactccagttaataatgaataatgaaaatgattatgcatatttctctgatgttctgataaataccagcacaccctactttttatgaggcaatgccattgtaaagaaaacacctgtttagtatctctgaaaaataaaaagaatatctaatgaaaaaattgccatgctgttatcattttgagatactgttatcaactcatgcaactttactaaaatctcattttagaccaaatttaattaagtgctctggagtaatgaactaataatgtttcgagatttctttgagccccatgagacctctcaccagaaagttttaaatactgggccattagtgtatcattttatgtgtccactctatctcccaagggaaaagataaaactttaggaaggcacagtcatgatcaatgtgtttgtatttgaataatcggtaatacataaagagagaaaactttttttaaaaaagaaggttttaatgaacaatgctgatagttgatactagtttagaaatatgttaatctccaaaaaacttcagggctgcacttacctcatatgtaatgaatgcttaatactgggggcgcaaagctcaattcaggccatcaaagaaacatacaaggtcacattggtacacaaaaggaaaaaggcagctaaggtctgtggaggtactgttaaaaagagtcggaaccttctgatatctttttctgaagattattttccttcttttcttagtcttcttttttttttcttaaacaagatgtcactctgtcactgaggctggagtgccgtgacacaatcacagcctcgacttctcaggctcaaactatcttcccacctcagtctcccaattagctgggaccacaggcacacaccaccacactgactttttttttttttttttagagatggagtctccctacattgcccatgatgatctgaaactcctggtttcaagcagtcctcccacttcggcctcccgaagtgctgggattacaggtgtgagccactgtgcccaggaaagataattttctattagataaaatcattgcaatcaaatgttgatggtatcaattttcccactaaattctacttaaccatgggatagcatatttgtacagtgctgtatggtttttaaagcattgccttaaatactttattgattttgaaaccagtatgtgagaaaggcaaacagttgtgatgattcttattaactatggttaaatgtcctacccaaagtcacagagtgaataagaggtggacatagaactggggagacagggttcattccactccattcattcaagcattcattcacgtactcattcatccaactaatggagactatggctccaaagatgaacaagatctagcctctgccctcaagaagtccacggtttagtaaagaagcagaaaggaaatcacacaccaagtaaaacatgagcatgaaaagtgtagcaaagggatgtatgcaaggctttcagatgaggtcaattcttaaatctgggtttcaatggagaaaggaatggctagggaatgagggctaaggggaaagacaagtgtagatcatctaattttgttcaaatacaaaagtgtatgtgagtcctggcagaagctgagagtatgaggtcagcagcagccaactcctggccttgaatgccttaccctgtgggccaagttaaggacagccaaggtgcttaggtccagaaatatgctaatctccaaaaagctttctgggctgagctcgcctcatatgtaataaagcacactggtggcaactttcatctcttttaatactgagatgtcttgaagcaagaatgactcaagccccaggtttgaatgagtaaattgtttgctgtagcctatgtatgtatacacacattttcatacacccacgtggatacggtttatatccataatactacacataatatatgtatccacatagataatacaaaacatacacacaactctataaacctcacatgcagagccatctgaataacatgtatgtttatactgaccccttgagacatgctctgatggacacaggttactcagagaggttacctgtgcaggacaaccatgtgtcctaggtgatttcagacagtcgtttgcctgcagagtaggcattgaaccagggctggacaagatgaattccaaaggtggcctagagctccatggtttcatgtatcacaagcttacttgcatgaagtagtttcgccattctcaataaataaaattccctgaccctggtgaaattattcctttctgctattcttttgtactcaggcagaaaatgtattattgatttctgattccaccacagaaagtgtgacttagagaaaagagcactgaatgaggagtcaggaaatctagattatttcctcaaaccacgctcctcgctgtcccctccccttgttactgtgtgaccttgaacaacttacttcacgcctctgggcttcagtttcccaagtgttcaatgaaaggagtggctgagtgttctacaattctctttccagctctgaatctataaaacaattccagcccatccctcaagatttagtttatctctgagctctaaaaatcagggctaaaactggattcaaagtacctattttctaaccaaagaagatcctgcttcactcacttttaaaccatgcaaatcttgcataatttaaatgatcagtgctgtcattggttgctctggtttaaattatgcattgttgctatttggggaaaatttagactgggtccggtctggaatcactggctgagaacaataagcccccaaagtgagaaggataaaggcctctctagacaggatctgcttttaatgctttgagcccagggtttacaaaaagagcattgactgtgtacattaaagagccaccgaaacagcgagggactggtaagtctgcagcaaattctcccagaagccactgaccttggctgcatttcaggggtcaggcattccccaggaggggctcagcaggcagactttaccaagggcttaggaacaaatgagacatctcatctagatgaggccacctctccaaatgtggcaaggtggagatgatctgccctctgatttgtggagattacctatgtggcctttggacccactccagcagacacacctcacccacaagactggtcaaagaccctggccctccaggatataactgtctccacatctgcatctaagtcttctagccagcagttcctggtccccaagctagctgttgccctctctgtttccacacctcccagcaggcagaaaaacagaagcagagccctaagctgatagcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatgaatgagctttggctgcccaactatcagaacagcccatttcaaacggcatctctgtttcttctcaactccttacttgccttgctgaaacctcatctcttagcccaacagattaagacgaagagagaaagacttattcaaagagatgtggaggaaaaggtttaattaaggagaccaaagagaaagtaccactttgatcacaaaggtagcactttaatatatcagtgcagatagcggcaatgtcagaagtactaggaatccaggtaaatggccccaagattcagcatcaatctaacaatgtattcctcaggagggcgtgtgaacttccatgcttcatccatcctggtgtctccctgtagagagccaccatgaattccttctcatccaccctccatacatcaagtatatgcactcgctttctttttaattttatttttggttcgggagaggaagaagcagtccttaaattggtgtccaatccttctcagacacccgctgctgccaccatccccacccctcacccccttccaggcaggcagcatctaattaaaatggcaagaaagctctgcccccttccccaaaggagtgtgttgggatcgggagttgggggtggggaagcgtcgaagcagcacttggattcctggtattctgatctcaaaacaacagcaaaatggattctatatcagtgatgtcttagtcaatacaatgaaacggcgtctgaggtaattcacgtgaaggtaaacgcaaaccagtggggctggggggagggaggtgctctacaaaggactggccacagacacggggaaaacacacacagacacacacacacacacactcgcacacactccagggagttccggtctgattgaggaaaagcagaaaacacatccctttcacctgcttaagttcagccataaaactgaaacgttacagccacaaagtcagaaagaacaggcagggctgagttaaagccataaataaaggtgagtggcagactggcatttaagggagcgctgagagggcgcccgggcgcgggaggtagaaaagggggagggggaggcagttgccatctacaagaccagcatagcaataactgcccccttggagcggcaggttcggcttcgcggggacagccagcctcacaatgtcatcttgcaggtagctggaaaacgtgaggggccagtgcctttattcacgctggcattctttttgcagaagggacagtcgggtctcgcgccttggcaccagacaactgcccggggcgtgtacacacacacacacacacacacacacacgcacacacgcctttcattttaatgctcttacaccggtataagatgaaactggcataagctctacgagccctcgggagagcctaagccacggccagaggaagacacgtaccgcacagcccctgccgtaggggctcagccaggagcacctcagcaaccccgaatcaaaacgggaatccaggttccctccccgacgcattctcccgctgctgtccccctgccccagccccagcccccagtccacgcaccgagcccattcaccctaacccaaaccactggaaagaaaccagaaaacgtcctgctcaccctcagagccgagagatctatttcatccaggcttcgagccggggagtcgctcgccatgtctacttcttcgctggagaaatggaccaaaaccaccccgaagcttttcccttggaaattccaccttggtctatttcactcgcgtcctcatgcgggtgtcgcgccagaggccccgggcccagcctcccccgcccaccccagccccacagcgccggatcccgatcctccgcgcgtcggtccgccgggtccgggagcccagcctgcgcggatctccaagccccgagcagcggtgcgtgtgggctgagcgccccgatcggctaagggcgctggggctgcgtgggtgtatttaaatgggacatgcttctttgcttgtgcgtggatggcggctgcattggctgttataatgagacacatcaactcctccactcagcagggggagggtgggggtggagaaccacgcagaactgtctatcaccgcttcctgggaggagtgaagggggagtggggaggcggaggaggcgtggtcttggactggggagaggccgcgcttcctgacccggtccctctgcaccagcgtggaggggggaggggcgcgcaccctttccgcccaggcttttgcgggctcctcgggccgaacccgaaggggctgttcctgaaccttgacttgttatcatagggacccaagctctatttttgtgtggccaattcgtgcactgcagcaaaatggcccttcagtcgcgtcttggggtttctcctcggttcaaatgctctcgcgctgagaaaaagccggaggaaaaaaaagcgacaccctccctcccccattaattatttgtggggccggagtaacgcgggctggtgcaaccggtgcatataaggacttgtgtgcaaggaaggggatccgcctccaggcgcggaaagagtagggaagaagcgcacacgcacagtgcacccagctgggcgcttcggcagtttgcagctgcggcggggtcgggtccacccgcggtccccggaatgccggacggctgatcccgggtgctggtcactcgccgattcggggctgggaaggtttgccagaagcgggaaagatgggagatctgagcgctctcttggcatcgccacacccaggacttgctcgtgccgcaattccccacggaaacaaccgagttgaaacgagaagcttgctctctgggtgcagtagctagaaggcttcaggtaactccaaagccaacactgggtgaggcaacacacgccgcctcaggactcagcatttctttcaggctgcgttttcgtggcagacctacccagattgatggagaaagtttggctggcggataagaagtaacgcggaagatgtgtacgtgagagcgatttcacttcactcactttctcatttaaaggttggatgttttacagtggtatacatgattctccttctgtaatcaagagtgggaagtcgcttcccccaatccccgcgcagcccttcttctcccgccttagccatgcaaaatacctagaaagaaaacactaaaactgaacttttttccaaatacagcagtagctttgaaagcattctttgctcctctgttaacagcagaatgtaattctgaccactgcactgatggtttcttaatcatgcagtatgaagatcagcttcaaaataagtcttatgaatgaatgaatgaaagccagtgcagttagttcatcatgactgcagacattagaggactttgaaacaacctttggtgtacattgtactgtttttgttactgatattgtatgtattcatatgcattgtggatcatgcaccatgaaacttgaaaattgttccaacatctcaatggccacaacagtttggtagcttttgcctgtaaacgttgtatgtaaacatttgaacgtgttatactaaattactaaactcattttttactaaaatcatctggttcgacatagtaagtaacgtgcagtaagccaccacgtcgaaatgaaaaaaaaaaaacagattatttcccatcattgtctttgtttttttctcttctgtgttcctgtttttttaccgttcatctagacaacaggttaatgtattgtctcagggttgaaagaagataatttaagatcaagtattaagatctataaacaactatttttttaaaactgcaaacataaggaaatatgagttaaatattttttccatggaaagccttcgttttatactcatgattatatttgaaacatcacaaacagatcaacttttttgacattagtgagctgtttgggccacgagggtgccaagttggcattcagatttagtttagttttagatgagaaagttatagatgcagtatgatgccaggtgctaaatggaggagggcttcctaagagcctgagaagttgatgagacagccaggggaaggcaggggtgtgggctgcaggaaataccataaaaggagagattgcagtatcaaagggacctccaactggtaaaggaaggtgagaaggaggaacttgaactttttccttttggtcaagtgtgtatcaaatttcagctattccagtataaatttcctaattttttcctatgtctctgtattgcctgtactattttaccacttacttaacatttttctttaaatcaacacttttttcttacacttaatataaaagaaaacataaatcactactctaaatggaaagccaacaacacttgctttgaaaaaaaaaggggggaggaaaccattaaaataaatataatggaaaataaagaagtattattaaattctagctagccatcaattcctgctctgggcttctagcctaaggcctactcttagtttgttaaaagagagaatagcaaataccaggaaaaacattcaagacttgagatttttttcttgatgtaatctgaaggattaagagaactgacaccatttatgtgcagtttgaaaacctgccgaataatacactatgctgtttacatatgtataaatatgtagtaaactatataaagcatggatacaggcagtaaggatacagattaacttcaggataatgagaaaagaggaagaggaaaaggagactccaacaatgatacctaatttttttgctaaagatttctgccaggcacggtggtggctcacacctgtgatgccaacattttgggaggacaggttgggaggatagtttgagtccaggagttcgagacccgcctgggcaacttggtagaaccccatctctacaaaaaatacaaaaattaggtgggcatagtggtacacccctgcaatcccagctactagggtggctgaggtggaagaattgcttgagtccgggaggttgaggctgcagcaagccaagataagccactgcactccagcctgggcgacagagggagaccctctttataaaaatgaatagaaaatttgaataataagtaatactatgctgcagatatttttctaagcatttgttctatctgaatgtttgtgtctcccaaaatttatgtgttgaaacctaacccccatagtgatagtattaagaggtggaacctttaagaggtgattagatcatgagggcagatccttcatgaactggattagtgccctgagaaaagaagcttgagggagcctgttcgcccttccaccacatgaagatgcatagaaggggccatctgtgagaaaggagccctcagcagacttcaaatccgctgatatcttgatcttggactttccggccgcagaactgtgagcaattctgtttctgttgtttataaattacctagtccaaggcatttaagtaatttaagtaacatggagaataaatccagaaggcccaatattcatctgataagggatctagagaatggatggaaggaaatactcaaaaaatggtagaaaatattccagtatcttgactgggcacggtggctcacacctgtaatcccagcactttgggaggctgaggagggcggatcacctgaggtagggagttcaagaccagtctcaccaacatggagaaaccccgtctctactaaaaatacaaaattagccgggtgtggcaatgcatgcctgtaatcccagctactagggaggctgaggcaggagaattgcttgaaccctggaggtggaggttgtagtgagccaagatcgtgccattgcactccagcctgggcaacaagaatgaaaaaaagaaaatattccagtatctttaagtaaaaagctctcatttagctctgagccaaatgcataggtaaaaaataacacacttaaacacctcacagtgagatttcagagcatgaaggataaaaagtaaatcttaactggattaccttctcatcagcaacaatggatgctaatagacaatggaacagtattctaaggaaatcattgtaatggtgttttgtcttgttttgttttgtttttgagacacagtctctctctgtcacccagactggagtgtgtggctggctcattgcaggacctcagtgagttcaagctatcctcccaccttaactaccttaaccccaccaccacccaataactgagctgggaccacaagtgcgtgctgccatgcctggctaatttttttttttttttttttttttttttttagagctggagtctcagtaagtttccttggctggtctcaaattcctgggattccacctcggcttcccaaaatgttggaattacaggtgcaagccaccacgcccagcctctaagggaattgtttttaacctagactaccaaactaaattagcacttaagagagggtacaaaataatgacacatattttcagatatgtaagagttgagattgctgcccatccttgaaattacttttagagaatgtcttccaccaaagagtaaactgaatccaaaaacaaagtgtgtgttacaaaagacaatgataaacaaaggtagcaaactctgttacctgctcaaagccattctttcttccttactagtaaaacaccgattttgacaatttaccctccatgtgtgtaaaacatatagattctccccagccccattctattctctctcctaatgattggtttagacataggcatatcattcaacactgactactgagaagtgcagagaagtctggtagggcttatagatatggttttcctccatcgggcaccgtggcttacgcctgtaatgccagcactttgggaggccgaggcgggcggatcacctgaggtcgagaggttgagactggcctgaccaacatggagaaaccccgtctctactaaaaatacaaaattagccagccgtggtggcacatgcctgtaatcccagctactcgggaggctgaggcaggagaattgcttgaacccaggaggcggaggttgcgatgaccccagatcacggcattgcactccagcctaggcaacgagagcgaaactccgtctccaaaaaaaaaaaaaaaaaaagaaagaaaagaaaagaaatggttttcctctttgaaagttgaaaaaagaaaaggaaacaaggaatagggaaggaagatcggaagaaatgaaggaagaaggaaggaagagaagacaaaacaagagaaatggccaggaaaagcttccttcccatggtagctatgcccaagatgatttccaatgagcctcactttctggtattcacacccttgtgtggatccctccaacatggaatacagaggacttccaaagctgggtaatacaaggcatttcagcttttaccttgctctcttggctcacttgctctaaggcaggatttcttaacattagcactattggcattttgggcctgataattcatgttgtgaaaggctgtcttgtgtcatataggatgtttagcagtaactctagttccaacccactagatatcaatagcaactttccagttatgacaaccaaacacgtctccagatattgctaaatgccccctggtgagaaaaatcacccacaataagaaccagagctctatgggaagccagccatcttgtcccacagatattcatgcaacctgcctgccatgttgatgagtcgctttgaagtggatctctagccccagtcaagccttcagatgactgcagtctcagctgattctgacagaaacctcatgagagatcctaagctagaagcacccaaccaatctgctcccgaatccctgacccacagaaatcatattattaaaataataaactttattgttgttttaagttgcttgatgtgttatgcaggaagggataactaatacattattttcagacagggttgtgtgaggatataatagctggaactatagaagtcttcttcctaccagggtgggaggagcttcaaaaaaagtgaaaagatgaaaagaacctggatcctgcatgacaccattgaatcactacattaactaacccaggaacaaactgtctttgaatttctttttgtgtgacataagtttttctcatggtttaagtcagctttagtggagtattctgttttttgcacccaaccactttctgttatagaaaattttaaatttttaattgttttcatcattgctagttaataaaaataaataatgatagtctataactaaatgatgttatcacaaggataaaaggcaagaagaggaggaaaagcatgctaagatttttttgtcttatttggagatgtatatagatactatctctaaacacagaaaagtatatcaattatgcataataaacataaggtcaccacatagatggatacaaattggatgtttaaagtacaggctacttgaatggaaaaaaaatgaaacaagagtaactatgaattcaataaaataaagaaaagaaaaaatatcaaccagaatgagtagtatgaagaacaagtttttagagtggtggggcccacccagtatccattctgctttggtatactgtggtaggcagaataatggcccctcatcgacgtccacgttccaatctctggaacctgtaattacgttaccttacaaggcaagagggactgtgcagatgtgattcagttaaggcatttgagatgaggagattttcctggattatcagagtaaacccaagtaatcacaaagttccttaaaagtaaaagagggagtcagaaaaggactcagagttagaggaagatgtaatatgaaaaaggcactgagaaatataacattgctggctttgaaaatgaaggaaggggcacacatacaccaaggaatatgggcagccactagaagctgaatcaggcaaggaagcacattgtccccgggagcctccagaaaggaatgcagccctgataacatttttttttctttctttctttctttttttttttgatggagtcttgctctgtcgccaaggttacagtgcagtggagctcactgcaacctccgcctcccgggttcaagtgattctcctcctgagtagctgggattacaggcatgtgccaccatgcctggctaatttttgtatttttagtagagatggagtttcaccatgttggccacgctggttttgaactcctgacctcagatgatcctcccaccttggcctctgaaagtgctgggattacaggcatgagccactgcagcaggcccttttcatttattttattttattttttgagacagggtcttgctcacttgtcactgcattcctaggctggagtgcagtggtgagatcacagctcactgcagccttgatctcttgcacttaagggatcctcccaccttggccactgaagtaactgggactacaggcgcaggccaccacgcttggctaatttttcaattttcttgtagagatgaaatctcactatgttgcccaggcagatctcaaactcctgagctcaagggatcctcccacctcagcctcccaaagtgttaggattacagggatgagccaccatgcctggcccctactaacatcttgattttagcccagaaagacccattttggacttctgactataggataatagatttgtgttatttaagtaaagccactaattttgaggtgatttgtcacagcagtgatttaaaaaaatgaatacaaacttcttttatccatttttatttttaaatcattgtctcttttcccttggttacagattattgtggctgtcactcaggttttctgctcattggtagacaaagggtgaggaggtgactgaaattggaacagtggaaggacccttcaccaaaacctggaacttcagaagaatggcagggctgaaaatgattagtgttaattcattccagttgtgttaccctacccataaggtatgactagagaccactcctctttcctagttcgaggaataggaagccttgtttccttgtatcttgttcgtttccaaacttggttctctgtgctagttatttattgctttataacaaacaaaccacctctaaactcaatgacttaaaacagtaacagtcatttctgtagcttgaaaatgtgtaatttgggcaggatttcgtggggaattctcatttgctccacagagcatgaggtagggctggaggacccacttccaaaatggcttgctcacatgcctagcaagtgtggtgttaggctatcaggagtgctcagccagggctgatggctgggagcttctcttcctctccgggtgggtctctccacggtctgttggagcttcttcatggcatagtgtctgagttgcaagaacaagcatcccatgagaaccaggtagaagctgtatttccttttctgacctagcctcagaagtcatgcgacttcatttccaccactgtcatgaatctacccggactcaaggggaggatgcagagatgccacctttcaataagaggattatctaagttgcactgaagaagagcatgtgggatggaagatactattgcagtatttttggaaactaaagcctaccatattcttcaagccttaccatcaattctgtgtcctcagcattctcccctttgctcacgttagcgagagttagtttctacttttgcttgtaaccaaagaataatgtagctggcataagcacaaacatatcagaataagtataaatatttaaacttccttattaaaagacagaagctctcagaatttgtagaaacaaagcaaagcaaccccaataaattaagaatgtggatgcttttcaaatctctcacagaaaattaacaacattggaccaggccaaaaagtacgctttttataatttcccaaaagcaacaatcatacataccatattattagtagatttcaacattcatgtaacagatccatctaaatctgtaattctcaattattgaaactttttcactagaatgactttagtttctcattatacttaaagttactcccagaggcccacccaagaatttatcatcatcttgaacagcttttctttagaaaataaagctccaattttcctttgtccaattagtctacccttccagctccccggcagccttcactgacattactgctgtttttcactgacattaccgctgccttacaaagactctatttctgtacattggtagcattcttcattattttccaattggtcttacctcttacccttcctctttccaattttgtgctggacctcagactgcctgaaggagcctgaacttccacgtgctgtcttccatataatgtgatctgaggtgaagagcatggtccctggagttgaactgcctgaagtaaatcccaaaatagaaaaataaaaataaaacagtggttttattgtttttatttcttgtttctcattgataggtagatagagagttttctttaaaagcctagtgcttttgggataataatggcaagtgattacatctcttttgtattaaataggtttggagaaattttcttaattatctggtactatttaaactcaaaggcaaacacaacactctatctaaaataccagtattacactttccctaaatgcagaaaactatttttactaaaaatttggcaagcactttcaaaacagcatttttctgttttcattccttgagaatttcctaacaagtatgcatagaaattttaatatagagctttaatccttcaatatttattgtaaaagtttaattgtttatcctatttttttggaagttgcttaatcttcttaaatcctaaagcggttttaaatgtaattgtattctggccaagtaattgagttttcagcttgctttcccctcaatattttcaggatctaacctagtatcctgcaacagtacatacatgcctagtcaatgaccaaacatactgtaactgaaatgatgaaaggacatttattctgattaccaaggcctgtgcagactatgtcataagtctggggtgctttgctccctgctggctatctcaatgtgctttcacttttcccatataactttttttttttttttttttttttttttttttttttttttttgagacggagtcccgctctttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaactgctgggattacaggcgtgagccaccgcgcccagcccccatataacttttttacagaactgtgtcctgtttaattttaggattaaaatgtcccataccccaccatacacgcaaaataattttcagttcttttatttcatgttcctatatttgaatggcataaccccaggttagctagagctaggggaggggatgagtagcctaactggacctttacatgaagtcatagggtagataaaagtgcttatcagacttttcaagctggaagggaacttacagataagcaactccaaccccctcattttacagataaggaaaccaaggtccagaaacactatgtgacttgctcagtgtcacagacttagcacaggaaagggctttggggactgaagactttgtgctaaaaaaagaaaaaaaaaaaaaaaaaaagcaaggccttatttatcagtattgtctcccaccagattccccatatactgtttcttctactctaccatattgtgtcccagacattcaaagttctttccacttgtgttgtgctttttatcttaaggaaaccatacaagtacagaacttgttgtatttcccttaacgtgtgggctgcctgagagctccaagctaaatgagttggtttgccatgcctggtactggctcttgggtgggagaaagtgccaaaaatggagttgagaggcttggctgggtgggttcttaaagccagagaactcagggaacaaagtaaggaatggggagttgtttggattcattagccgaagaaaatagaggccaaacctctccagaaatttaacacactctcatcatgcaattacatggatgatttttaaggtggatgctggaaaatgcattctcttttgtttagtacttaagacaccgtattgtagttgctgtctttcttttctaccatggagctgttgattgcaaggatcctttcttgctcatctctttttctctagtgcctagcataattgccacaataaagtggtgtgtatttaaaaaataaatcaataaatcagtgtagtgaagttggtaaaggtagatgaaatgagccactttgaagccagaaaattctggacaaatcttttaagtcccctaagtgtcaacattttatgtttgttataatttcacgtggctagttgattctgagaataaaccaagattcccattgctgatactctatccaaagctgataataaaaattaattatagatccatctttctcatctagtcacagagtgtaaattaattcactcattcatatattcattcatcaaaaacatggattgaatacaaagatcatcaagatggcctctgccctttataatttaggcagtgtttctgaaagtatgatctctgatgcactgacatcaaagaggggagcagggcttgattaacatgtagattcccagagtgtggggggccagggctcaggaataaacataatgaaacttaggtaagatgtacagagagtataagagctgagaggggtggaaaggattcagagacagagtctaggacatggagaaactaaaagaggatcctaaagctggttgggcagaggttctaggcctttgtagatgttaatgagttagtgattaagtgatgttgttagtgagctagtgacttgtagatgttatgagtgagttagtgagtaaggaagaccctgaaaagttgcttagtgtcctttgtcttccactctgtcacttataacggaggcagcctggccacaccgtgctggaactcttcaaagctctcacagaaccagaccaaaggctttttctgttgaatagtgctatggtctaaatttctgtgtctccccaagctcataggttgaaatcctaacccctaggacaagaggtggggcctttgggaagtgattaggtcatgagtgggattagtgcccttataaaaaaggccaaagagatccttatcctttcccccatatgaggacacgtgagaaggtgctgcctatgaggaagcaagccttcatcaaacatggaatctgcaggcatcttgatctcggactttctagcctccagcactgtaagaaacaaatgtctgttgtttataagccacccagcttatggtgttttgttatagcagcccagatgcactaagacaggctcagccaaagcaagagtcaaccttgctccagaaaggtagtagagctcttggctcttcagcaatcaggctgtcctattatttcatccttttaagccataccagaaccttttacctctagcttaatacctagaacatgggacatttttaagttgagttcatgcttccctttgtctttgtccgcagactgacacagcctggaaaaacaatcatgagtccattctatggcgacctttttgttaaatccctctagcaggtgacacaaattaattcaagcccatccttctcaagttgtgccttgcaattgctctgttttctttttttcttcatgagacagagccttgctctgttgcccaggctggagtgcagtggcacgatcttggctcactgaaacctctgcctcagcctcctgagtagctgggactacaggtgcctgccaccatgccaggataatttttgtactttcagtagagacggggtttcagcatgttggccaggctggtcttgaacttctgactaggtgatctgcccgcctcagcctctcaaagtgctgggattacaggcatgagccaccgagcccagcctgcagttgctctgttttctgatggatatgtcctgggaatatgagcatctctctgcttgaaatctcagcctgaaagccttctgcagtttaggaggaaaattcctttgatgattcttttattttttaactcttattttgaaaaattctaaacatatgcaaaagtagagtatatctgatttccctttatacatcaccagtttcaacagccattagagtgttatcatacttatttttatctatttctcctcctcatgctttttttctttcctaaaccattttaaaacaaatatttaggccgaggcgggcggatcacgaggtcaggagatcgagaccatcctggctagcacggtgaaaccccatctctactaaaaatacaaaaaattacctgggcgtggtggcgggcgcctgtagtcccagctactcgggaggctgaggcaggagaatggcgtgaacccggaaggtggagcttgcagtaagccgagatcgccactgcactccagcctgggtgacagagtgagactccatctcaataaaaaatatatatatatttggcatcatgtcattttacttctaaatatttcagtatggatctcaaaaaagaaggagggatttaaatatgggctgtgcttagtgacatgcttccaaagcatagaggatggaaatggggggagatgtaactttacagtggagaaacctagtaaacagcaaatactaccttggtcaggtgatcaagattaacatcattagtgataagtcatgtggacagcatgtatctttgatatgatataatgaaaaagatactagtcaaatacaaataaattgtgtagtttagttaatagtaatgtgcctatgttggttccttagctgtgacacatgtcccagagtgatgtaagatgctcacgaaaggagaaactaggtacagagtatgtaggaactctatactatctgcaaatttttggtactctaaaatgttttaagtttattatttaaaagggaagcaggacaactacagtgctactatcacacttaaaaagaaaagttgccccaaaccaggtcacagacataacatttttgcatggtggaattcataaccaccttctgcaaaatgtatattgcaaagtgtattaatagttaaacatccaaaaaatgtattgagacaccaccctttaaataaagccttcaaatctaaactatatgctagtacccaagaaccatctgaaagccaacatgctttttcaggtgtgtgaaacatgctgtcaaggttgtgggttgattgcagtgaagatttttaaagagaaaaattttctattttattgtcatataataattacgttaatacctcctatctgaataacaccaacagtttacacagaagtttcatatgcaccttcttacttacccctcacaataaagtagatattatcattatactctttcacagatgtagaaagtgaacaggaaagtaaatcgcaatggttttcaaatgttctgcagactagaaaattcttatcaagtcagataccatgtagaccagtggaacagattagagaacccagaaataaagctgcatacttaacaaccacttgatcttcaacaaacccaacaaaagcaatgaggaaaagactccctattcaacacatcgtgctgacataactgatacatatggatacatatgcagaagaataaaactgggcgcctacatatcaccaagtacaaaaaattaacccaagatggattaaaggcttaaatgtaagtcctcaaaccattaatataaaaagcctagaagaaaacctaggaattacccctcttgatactgggcttggcaaaaaaattttggttaagtcccccaaagcaatgacaacaaaaccaaaaattgataaatgggacctgagcttctgcatagcaaaacaaactatcaaggaagtagggccaggtacagtggctctcgcctgtaatcccagcacttcgggaggccgaggcaggcggatcacgaggtctggagatagagaccatcctggctaacagggtgaaaccccgtctctactaagaatacaaaaaattagccaggcgtggtggcgggcgtcggtattcccagctactccggaggctgaggcaggagaatggggtgaacccgggaggcggagcttgcagtgagctgagatcttgccactgcactccagcctgggcgacagagtgagcctctgtctcacaaaaaaaaaaaaaaaactatcaaggaagtatacagacagacagcctacagattcggggaaactattcataaactatgcatccaacaaaggtctaatgtccagactctacaaggaacttaaacaaattaacaatcaaaaaacaaccccgttaaaaagtgagcaaaggacatgaacagacaattttcaaaagaagacatacaaggggccaacaaacgaaaaaagctcatcatcactaatcctcagatagatgcaaattaagacctcaatgagtgccatctcacacctgtcagaacggtttttgttaaaaagtcaaaaaataacagatgttggcaaggctgtggaaaaaaggggatacttatacactgttggtgggaatgtaaattagtccagccactgcggaaagcagtttggagatttctcaaagaactaaaagttgagctactgttcaacctagcaataccattactgccattactgggtatacaccaaaaggaaaattaattgttccaccaaaaggacacatgcacctgtatgttcattgcagcacaattcacagtagtaaatacatggaatcaacctagatgcccaccagcagtggactggatttaaaaatggtatcagccaggtgtagtggctcatgcctgtagtcccatactttgggaatccaaggcaggaggattgcttgaaactaggagttcaagaccagcctgggcaatatggcaagagagactctacaaaaatttgttttaattgttttaatttaatgtttatttattttaatgtttacttaatttaatgttaatttaatttatttaatgtttatttaatttaatgtttacttatttaatttaatgtttatttttgtttatttcaagactgtctcgaaataaacattaaattaaaaataattttttaattatttgaaattaaataatttcattgtctcaaaaataactaaaataattattaaataattaaaataattaattaatatttattcaaattattttatcattatttaaattaaatattgtttaataattatttttgagacactggtaaggctgtggagaaagggggacacttatacactgttggtgggagtgtaaattagtccagtcactgtggaaagcagtttggagatttctcaaagaactaaaagttgagctaccattaataaaaataattaaattaaattaactaatttagttaataaaaataattaaataataaaatatttgataaatgtaattaattatatctattaatattagtttatttaataaagataatataataaatacttaattgttatttaattagtttaattatttaataattattttcaagacactttgtcttgaaataaataaattttattttgcccaggctggagtgcaatggcacaatcatggctcattgcagctttgatttcctgggctcaagtgatccacttcagcctcctgagtagctagggctacaggccagtgccaccatgcctggcttttttttttttttttcaattttttgtagatgggatctcactgtgttacccaggctggtcttgaactcctgagctcaagcaatcatcctgcttcagcctcccaaagtgccgagattagaagcttgagccactgtgcctagccaaaaaatttttttcaattaaaaaaaaattgtgggccagacgcagtggctcatgcctgtaatactggcacattgggaggccgaggtgggtggatcaagaggtcaggagattgagaccatcctggctaacatggtgaaacctcatctctacaaaaaatacaaaaaattagccgggtgtagtggcgggtgcctgtagtcccagctactctggagggttgaggcaggagaatgacgtgaacctgggaggcggagcttgcagtgagccaagactgtgccactgcactccagcctgggcacagagcaagactctgtctcaaaaaaaaaaaaaatgtggtacatttgcatcatggaatattatgcagccataaaaaagaatgaaaccattcttttgcagcaacatggatatagctggaggccattatgctaactaagtgaactaacacagaaacagaaaaccaaatactgcatgttcctacttacaaatgggagctaaacaatgggcacatgtggacataaaataggaataggcactggggactgctagaagagggagagagggatgggggcaaggactgaaaactaccttttgggtactatgctcaataccagagtgacgagttcagtcacatcccaaacctcagcatcatgcagtatacctctgtaacaatcctgcacatgtatctcttgattctaaaagaaaagttgaaaaagaaaaagagtcagatatataaaaccaatagggacaaagataacctttgccttcaaactactgcagctaaccactcccaggaggttattttatgcacggtttaaagactaaaggtgtaatttggaaaaaaaaaaaacacaaaaaacatgagttttagattcagacaagcctgatgttgaagcctggctgaatatttatgagctgcatgttactttagatacattacttaacctctctaattctcagtttccaaatttgtaaaatggaggtagtaatactctagagctccgtgcagtacaaattcctaaccttagccgtatctttgtctccccaaagggctaaatggattttctgaaagtattgaaagagtggctggcagaatctaattctgccaccaagtacattgcttttgccactacatcatgtgactgtacattgtactcccaaccaggtctggagtgcgtggcagtgacacatgctctctcctaaagaaacagggtatgtgcatgtcctgcttttttttttcttcttcttcgtaatttcattgggacacatttatcaaactgtttttctttgttttctgagacagagtcttgctctgtcacctaggctgcaacctccgcctccaaggagcggattctcatgcttcagccacccaagtagctgggatgacaggtgtgtgccaccacaccttgctaatttttgtatttttagacagatttttgccatattggccaggctggtcttgaactcctgacctcaagtaatctgcccacctcagcctcccaaattgctgggattacaggcgtgagccactgcgaccggcctgtgcaagtcctgttgatggcgtccttcttgtttagtaacagcagcagagcaaccaactgagaaggaacatttaaagcatgtgttcttaaccagagtcctagaccctcacatgatcttcaagtgctccatgaacccccctgaaattgtggacatttttgatgtctgcatatgtgcatttttctgaggaagatggtccacagcttcaaaattatcaaaagtattccaaaactaagaaaactttacagctcgtgggccaggcgtggtggctcatgcctgtaattccagcactttgggaggctgaggccggtggatcatctgaggtcaggagttcgagaccagcctggccaacatggtgaaaccctgtctctactagaaatacaaaaattagctggatgtgttggtgggtgcctgaaatctcagctacttgggaggctgagggaggagaatcacttgaacccgggaggtggagctgagatcgtgccactgcactctgacctgggcgacaagagggagactctgtctcaaaaaaaaaaaaaaaaagtttagagctcatggattaagacgttcttgcctttatcatggatgttgattttcctattttaggaaaagagccaaagcttgttattaccttattgagtttctgtataacagaggcctgtgattcctgaattttagtaagcttagtgataacctgaatacagcaacaaatacaaatatgacctggtattagatgatatttaaagaatcattattatttttgttacgtgctatttaagaaaacttttctgatcatttaattatgaacatatatggaagttttattaccacaatgcttttatatcatgcaagaaaaaaggcccctaacaagttcattcaaatattcactgctttattttatagaaaaagagactggtaagatactcaatataggacagattgaaaaagacagaacgtctaaagttcactcaatccttgactagtagtcagttggataggtcagtaaatgatttccagaacaagctttaatcccattaacgttcatcagaaaagtgcttaagaatttcaccatgaatgcaaatattggattttaagccaccgtgaataggtcttctcaaatgtatttgaattgattcatcttccattttaagatctttttaaaagctattttagaatttctgagaaatttcagatatggttattgggtttaccgtaatttaaaaatattattataactttagctggggactaaaccttaatatagggttttgagactggtcctgtctgtcagtcagtcatttggtgagttggtggagactgcacatctatactgtagtgggcataccaggagaataaccaccagaggtcggttgaaacatttagagcctggccatccaaaatcaaaggcaagggccaggcgcggtggctcacgcctgtaaacctagcactttgggaggttgaggtgggtggatcacctgaggtcaggaatttgtgaccagcctggccaacatagtgaaacccgtctccactaagaatacaaaaaattagccaggcgtggtggcgggtgcctgtaatcccaggtactcgggaggctgaggcaggagaatctcttgaacccaggaggcggtggttgcagtgagctgaaatcacaccattgcactccagcctgggtgacaggagcgaaacatggtctcaaaaaacccaaaaaaacaaaatcaaaggtgaaatccaatgcattgttgccaaactgacttgtgggtagaaatatcatcttccataattgaaatatatctttcataggtggaaaaatagccccatttccaatttaaacaaaaaacaactacaaaaaaattcatcttacatgcttcacacttcaaaaacattatcactttcattactgagtcatcaaaacttcctgagtatttcttttttaagtaaaaggaccaatcactaacctgttttcttttccacctcaccatctacaacaacaacaaaaaagctcagaaatagtctggtgaaactatgcagtgggcacggtttttctgtggctttcttccttccaccttctcagtcccttctcacacagaactcccagccctctctctccctgttctaagagtcctagaactgttaagggatgctttgtatctctcctaaagtctctaaaccaaagttcccttttccttcccttcctgatgaagcgaaccctgtatctttccctgttcctgacctcagtggagtgctgccacctgatccttcatttatttctagttcactccttatcacattccccagaatccctttccaatttttctttttgtcccagtacccactacacacacttaccttgcaatcttcttttcataagccactttgctacctatgatgacatgatggcagcaggcagctgctttgccgctactcacagtgtactatctgtgaatggtgcccctggagttgggtacacagggaacacattgggaatgcagctgggaggtgtgaaggtcacagtcttggatgaggccatctaaatggaatgaccacaggttacccctttcctcttcaagattcctcttggttgtcattccttcctccttgccagcacctccctttcttggcagaccacatgcttgggattgaggcagcccctttccagccgtatgactttgggaaggttacttaagtcttcgaagtatttattttcttatttagaaaaacggggatataatagcatttatctcatggtattatcaagtggaataaatgagataatgtctgtaagagtactggcccagggggatggttagccaagttagctgttgctataattcctaattctaaggctgagattctacccgtgaggtctgtaaagtctctctacagtctttgagaagtgatctgctcccctcacttctccatgaaaatttctatttttctccatatttatttttaaaacacattttacctcgttgatagctggaattgaatttaaacagtcctcaatgccttagaatgatcaaattattaacacagacaatctctccacaacgattctgtgcccactttctagtgtgtggtttttttgtttgtttgtttgtttgtttgttttttgagacagagtttcgctcttgttgcccaggctggagcacaatggtgcgatcccggctcaccacaacctccacctcctgggttctagtgattctcctgcctcagcctcccgagtagctgggattacaggcatgcgccaccacgcctggctaattttttgtatttttagtagagacagggtttctccatgttggtcaggctggtctctaactcccaacctcaggtgatccgcccacctcggcctcccagtgtgctgggattacaggcttgagccaccacgcccggcgtgtgtttcagcctttgtgtctcttatgctgcattggtcctcaccctgtgttctttgttcataataataataatagtagtagtagcagaagtaataataattaccattttctaaatgtgtctcttctatcagactccttatttacatgctcaatttaatctccacagttggttggtattattatttccactatatagttgaggaaactgaggtcaagagtttttcaatacattgcccaacgtatcagagcctgtaatgttgaatctggggatgtcttatcctaaaacccattcccactcctagccccaggcaaccactaatctattttctgtctccaagtacagaatgtttatgcataagattatgaatttgcctaaggagaatcacttgaacctgggaagtggaggttgcagtgagccaagatcgcgtcactgcactccagcctgggcaacagagtgagactctgtctcaaaaaaaaaaaaaaaaaagattatttgcctattctgagcatttcatataaatagaatcatataatatgtgaccttttgtgactggcttctttcacttaacattatgttttcaagatccatccatgtcacagcatgtatcagtacttcaatccttttgtggctgaataatattctattgtacagatttatcacattttgtttatccattaatcagatgatggacattcgagttgtttttactttctgcctattatgaataacattgctataaacatttatgttaaaagtttttatataaagatatgtatacaatcttcttactcagagtggaattgctgggtcatatgggaactttaactttttaagaaactgccaacctttttactaaagtggctgtactgttttgcattcctaccagcaatacatgagggttccagtttccccatattcttaccaacacttgttatcatccatctttttgattatagccattcgagtgaatatgaagtggtatcacactgtggttttgatttgcatttccctaatgactaatgatgttgagagtgccatctaattttatattattgttctttgtgtgaaaaggacaatccctaaattttagtggatgccaaatgaagaattgtctagataaatgtttctctcctctgtaattcacattctaaacttaatataatatttaaaatactaatttgcttttctgtagtagccaaaggaaaggctttgctcctgctgcagatttgtgtgtgtgtgtgtgtgtgtgtttgtgtgtgtgtgtgtgtgtgtgtgtgtgtgtgtgcttgatgtgttatttgttttgtttttatatggagaaggttttaagtacaaaagaagtacgtacagacactgatggtctctcaaccacctgcctcagcccacctgactttagagcaacttcaatgcacattccatacacttcctgtgcacaccttgagggcacactcctggcgcttgtttgcttttggcctcagggctttctccacagccatagaaggctgctcatctggatcctagagcccaaaagtgcaagagaaagaagagaggagggtagctttaatactgacccccaaagggaaccttcagtcaataaggtttagaagttgatggataaacactgtagcctctcatcccttgatgggacaattctggagcatggtcaactcagttccttagcaatgcccagcagacataagccacagttgctcacagtggaaacccactccttaaaaaccactttattggctttcctcttttctttgtctcaacttcccagctcccacatttctgcttcctaggatcacctcaaaaataagctacccactcaaaagttcttatctcagtatctgctttcagggaaacccaaattatgtaaaattatgaaaatgaaaaatggataaatgagtaaaggcagcattaattgattgaaaatttgcaaacaatttactttaaagaatcccttttgctatttttccaccatggacctgatgttttaaagattttttcctatgaaataaattgtatttgtaagataataataaatgttgtcttaaggtcaaagacaatctgcttttaatactagtgttttctccaccaagattatattatttttgccaaaaagcaaagaagactggagttttaactagtctacttaatatttatgtgtgtgtgttccattcgacttgttcaaaacagttccccaagtctgattattatactgtattattttttaaatagacacacagcacatggtgggaacccagaggctgagaattccatactagcaagttcttcccacgaagggtgttttggggaccagcgatagagcggtgccaatccctaggtcctagctgttggcagctttcagagcttgtttacactctcttcttttttgacttgtgatatcccagtttggtttgtagaccttgaacatttcacaagtcccttgcctctatcttctttttttttctttatagacagagtcttgctctgttgctcaggctggggtgcagtggtgtgatatagttcactgtaaactcaaactcctggactcaagcaatcttcccacctaagcctcccaagtacctagaactaaaggaggtcaccaccacacccagctaatttttttgtttgtttgtttttggtagagataaagtctcactgtgttgcctaggccgatcttgaactcttgtcctcaagcaattctcctgccctggcctcctaaagccttggaattaccggtgtgagctaccgcacccagtctccttcctctatcttaagtcagccatcatgccacttaacccagacttggcagctttgtgtggccatctctccacagctccacagacgtttgttattccccaatccgctgttctgtcctaattgccatcttctgccaaattgagaaataatgagactggctgaggcaggatagaagagcagtggtatcaagttagaagtcctgggttctagttccagttctgcccttcctcgtatggagacactagacaaagcataatctacttgagctccgtcttctcatctttaatgtggagatagcatgatcaattttgaattctcacagggtttgagagataaaaacttcttcagaaacaataaggcaaggaagttcagtgtagtgttgtttttgagattgaaaaattagaactggacttaagtatttaaatatgaggggccagttaaattatgacataatcattataatctttgcaaccattaagaattatgttggagaatagttaaaggtgttggaaattaagtggaaaaaaacaaattataaaacacttatgtgaaagtagagattaccaggagtggggtagagaagggcatgaggagttatttaatggatacagagtttctgtttgatgaaaaagttctggaaatgaatagtagtggtggttgtacaacattgtgaatgtacttaatgccacaaaaaaaattttttttttttgagacagagtcttgctctgttgaccagcctggagtgcagtggcacaagcacagctcactgcagcttctttctcctgggctcaagcaatcctcccacctcagcctcccaagtaactgggactatcagcacaagcccagctaatttttgtattctttgtagagacaaggtttcaccatgttgcccaggctagtctcaaactcctgggcccaagcaatccccccaccttggccccccaaagcgctggcattacaggtatgaaccaccacacccagccagagttgtacatttagaaaaggttaaacttgtaaattttatgttatgtatattttatcactataaaacaaaaggtagctggaaggttgacgaaggtagttcttaataaggtgaaaagaaaaaacagttctcatgtgaaatcatggaaatttcttgtaatttatgactattctaattttcatgggcatataattagatgagctattaaattatttacttgaaattttcggcacaaaaataaatgtgtttgtattttaaaaacaatctgtgtagggtgatcctatttttaaaatttatgtatatatattatatatgcacattataaacatatacacatatatatgcaaactacatgcatatctgctttttctaaattttctatggtgaatatttattactcctacaacaaatgaagtaccatataaaccataaggaattttattacttatatggtggctttggcctgtcatagtgtataatatgcaactgttgccaaaggaatatgtctcaggtaatctccaattggtggcttacttgaatttgcaggtggagacaacagaatatgcaatgtttgaaaagtgatggactctgtggctcatttgaggccttgaagtaagtccattatatttggaacattatgtctgtgagtggatagtgctgggataaagggctcaggatgaatctggagaggtaggcaagtaataaagagacaagttgagcacattagagtttggacttatcctaagggcaacagcaaaccactaatggggtttaagccaatgaaatcattaggtttacacattaaaaagattaaggtgtttgcctcatgctaaaggcaccagagaggagcaagactggaagcggagaggttgattatgaggctgtcatagtctcccaggccatctggacaggagtggtcaccagagggataaagcctgtggatctgagacacatctaaaaagtagaacttttgtgatgcttagttctgattggatatagagaagaagggtaagcactatctaggatgcctcgaggtcttagctttgggcaatggagaaggggctgtgtcacctactaagatacgaatcaagtaggaacttgtttgagggtggaggaaagtaacaggtttatcttggaacctgccgagtttggtgtctgtgcagttggaaatccagaaaaaggaaaactcagaagaggtatcaggagccagtggcatatagagggtaactgaagccatgagagtggacaagatttcccaggaagagcgtgtagagaagaggtttgtagtctttcttgggagtaaaggggtgataatctgatgaagtccatgaacctttccttcagaaacattctgaaggggcttggttgttaagcaaatggaagaaatcaggacatagttgagggttgtcatgaggtcaagaaagattgagacttaactatgtttagatagacaagtagtcaggaaatgattagagaaacagaagagaggaagaatattcaacgagaaaaccaaacccttgagaaatgacaaagagactggctccctaagacagcaaaaggcaagagtgttaggcaaaagcaggggcaactttttaaagtcaggaacaaggaagaaaagctagaagagaacgcaggtgagcttgtgggttggaagttgaagactttcttatcagatgacttctgtggactcagtgaataggaggtgaggtcatctaatgagagtcggcagaggtcacaggtctgtgaaatgtccactgtagagatcagatatggaaaacactatgagatttctaggcagtagaagcccagttaaacatggggaccaggcatatataacgacataaatctgggtgatttttcttcagcaaatcttgagatccttggtgaaagtgagaagaatgcaatggttcaattttttaagggctatcaatttgccaaggattgtgagtaaaagatagcagggcaaaggagatgaagagtcaaatgagaactgatcacagaatgatgaaccaggtatcaaagctgtctggaaataaaatgaggtcagaaagagaatgatgaaaggagacaatggaaatacctagggattaaaaataccaaagcatgcagccagccaacctgtgtgctcagcagttcatttgttttaaagacttttatttttattattttttaaaatcaccaagtgtcttgatgcacctatgttgtagtttgatcatgaattcctgaccagaacactgaagctgagggaagccatttgaaatcaaattccttgttccaacctaacagcaaagactgtataatcattaatttgcctttcaaatacaggaccagaattagatagtaaaatatgtcttgcattcccaaacttaggctaatatcacttgcacatgtaaaggctatggacaaggtattagataatattggagatttataaaccttcttatgtatataataatattgtagttatgtaggttgatgtccttgtttttaagagatgcctgtgaagtgtgtggaggtgaactaccagcttatctgtgacttattttcaaatggttatgggaaaatgtataacaaagcaaatatggcaaaatgctaacaattactgatcagagttaatggttctctacaaaggaagagggttaattttacttcctggggaacattggcaacatttggagacatttctgtctgtctcaagtcagggggagggtatgtgtatgcgtgcatgggcatgcactactggcatttagtgagaagccaggggtgttgcttgtcatggtttggctctgtctcaacccaaatctcatctcaagttgtaatccccacgtgtcaggggaagagcgtgtcgggaggtgattgaatcatgggggtggacgtcccctttgctgttctcgtgatagtgagtgagttctcaagagatctggttgtttgaaagtgtgtggcacttccttcttcactctctctcctgctcggccatggtaagacatgctggcttcccgcttgccttccgccatgattgtaagtttcctgaggcctcccagtcatgcttcctgttaacacagaaccgtgagtcaattaaaccttttttcttcataaattacccagtctcaggtagttccttatagcagtgtgaaaacagactgtacacagctgaatatcctacattgcacaggaaggcccccaacaacagaattatccatcccaaaatgccatagcactgaggctgagaaaccctgagctcatggtagatatatagatgatcatggtgccactgctagtctttcacctgtccaaaatattttaaaacttttgctaaaggaagtttgaaatgaaaactaaactatgagaacaaaagaagacatctatcttctaactagtaaatgataaattattattggtggtggtcagagattttgtttgtgattgaggattctcttgaaaaccatgacttttaggtggatggctggaaaccattcctcaccctccctatggtcaatcagtcaaaaatagaacattgtttttgttcagtactcgaattttttgtgcaaaatgttctcagaggaagaaaaaggaaggaaaatggactgttatagaccacttactatgacctaggtatcatgctgagcacttttcatacacagtcctgtctggcctggagtcagctgatacagatttaagtattcgttgtgtcacccaatgactaatttctttctttctttctttcttttattttttttttcttgagacagagttttgctcttgttgcccaggctggagtgcaatggtgcgatcttggctcaccacaacctctgcctcccaggttcaagcgattcttctgcctcagcctcccgagtagctgggattacaggcatgcaccaccacgcccggacaattttgtatttttagtagagatggggcttctccatgttggtcaggctgctctcgaactcccaacctcaggtcatctgcccacctctgcctcccaaagtgctgggactataggcatgagccaccacacctggccacaatgactaatttcattcatttatttaatcattcatttctccactcagcaaacttttattagatacctgctaagtttcagacactgctggaccctggggatatagaaataaataaggtatattgcttgacctcgagaagcatatggcctattgagggagacagaaaatttaatagtaagccatgagaaatgatcctctctagaggaatggacaagttcctctaggggcacataggaggtcaacaaaaccagagacaacttctcagacttgggatacttaggagtaaatccactcaagggacactggggtgagattggggtgagtgagctgtgagggtatggggatgagtgtagcattcagagcttgagacaggtctggagctccttctatgtaggtggagcaccatgttaaaggcctggagatgagagagaaaatggaacgccttacagtccttgcatgcattctaaggcttaatttcagcaggcatcagaatctcctaaaggatttgtgaaagcacagattacaaggcctcactctcatagtttctgattcagtgggactggatggggcccaagtagttgtgtttctaacaagttctcagatgatgccgaggctccctgtctaaggaccacacttagagaattcctgccttagagaaactacaggtagttcgactagggctgaagctgaagagatgatcaaatttggactaaattattgagccaatagggagctattgaagtgttttaaccacttgagcactttaatgcataatctctcttagcccttgtatcttcattgtaacatgggagactaataactatcaaactatctatctctcagcattcttttgagaataaaaccaagcaacattatgtaagtaaattataaaccaccatataaatgtcagagataattattaaaattaactcacttacagctgaaaatattctctttttccagataataaaactgaggtatagtaggcacagttggtatcagccaaagcatcttgggcctggctccagcatgctcaccgctgcaccaccctgatcctccctgccactccagtcaggaggaaaaatgttttagtgttacaaaaagcctctgctcccagttgtcattccaccttcttcttgaccttaacctattgagtgaagtagatggtgaggctgattgtcccagagtggaatctaagagaatttaacccagaggttaaatatgtagcccagctgagcaagggtggccggtaaagccgaggtcagacagtcaggcataactcacagttctgcccactaggcttacctgaggtccaagaactggcacagggtttttgccaaggagatgctgggctctgaggttgtctcagtcagcaagtggcacccaaaaggagaacttcaaagattcattcctgggaaaccccattaaggaaaataaaatagtttggggaattggcaacttttcagttttcctatcatgagtggaagaaacaaagctgaccaggcatggtggctcatgcctgtaatcccagcactatgggaggccaaagcaggaggatcacttcagttcaagagttcaagaccagcctgagcaacacagtgagacacccatctccatttaaaaaaaaaaaaaaagaaagaaaaaagaaaccaagctgtatgttttttatctttacgtttgtatgtcactttgcagtttagattcgcttttacttttactttctcttttgattctcatgggcagtattgttgttccattttataaatggaacatttataaaaggcataatttagaacactataaatgagaagttcagtggtttgataagaataacacatccagctggtcttcagatttcaaatcttatgcactggactccaccaaaatatttatgtgaaataaacgtagcatgtaacaactgttttcaacaaatgtggtgattacatatgtagtatatggaatcatctatctatcatctatctatcatctatctatctatctgaatgccttatatgcttttattttcccattttctcctggcaatactatttggttatttcatctactttttaattgtttggtttgtttttgattaaccttctataatctagtcagatgaattagaacatattttggtggaaataatccttgcaatataaggattaaaaatagtgaaaatttgtgatgtgattaaatgaaatggaattaggaaaaaatgcaggtttaatggtgaaaactctgcactgtaaaaagaacatttagttaatcacaggaattatcatttttttaaattcagaaaacaaagattctaaagctcctttaaacatttttcagaaataatgcacatagtacttctgtgagagtagccagagtgctaaagtaaaaagagagtccttgatcagctccctccacagccataaataatccagtccaataaactgtaaaggactcacggtatggtagagatcagagttcaaattcagcaagccattagaagcactggagaattttaagcactttttcttcccttcctgaataacgtctggcatttgtggaagatcactgatggtcatcaatttttcctcttacatagattatacgtatatgagcttgagcaaacctgggcttccgagggtctgtctttttaaatccagagtccatttgtttttcttaaaaaagattagtgccctgcttggaatcataaaccttcgagactgggatggagtttgtagattatccaggtgaagactgaataagttgcccagtgtcgcttggccagctgggacccaggtttcccgacttgctttcatggtctcatgatgattctaaggatgtaaagagactaaaacaagaataaaaagaaattatttcattgcatggggggaatgtttataatatactgttgtgtgaagaaagcacataccgcagtatatatcataggattctatttggtgggggaaggatggaaagaatgtatgtatgtatgttaggtacaaaaaaggccagggagatgtcagcaggcctaatagctctaggtggggcagttagcaggaattgctcttttcttccttgagtttttatatattttccagatttttaaatgaatacatataactttgataatcagaaagaaattgatgttataagcgagggattaaaagcatcctaagaaggtcacacaggcacatttcaggaatacaaagataagtagctttagaatcctttgtttccagagactggagagcagaggactgttatctgtagaagacaggtatttgaccagagctgtgcagcagtctgatgaaggcagatggacgaattggcacctaagagccaacgcacgggctacaagacaaacatccacagtgaggctgcagtgacagcctctctttactgggcaaagtcagcttacttcccacttcccgttactcctaccaccaaaaccattgcagaatcctgaactatgaacccctatgttcactttcctagagatgtggaatactcctctggaactgtggctttctgaaggaagctgattcttttttttttttttttttttttgagacggagtttcgctcttgttgcccggtgactggaatgcaatggcgcgatctcggctcacagcaacctccgcctcccaggttcaagagattctcctgcctcagcctcccaagtagctggaattacaggcatgcaccaccaagtccggataattttgtacttttttaaaagtagagacaaggtttctccacgttggtcgggctggtctcgaattctcgacctcaggtgatccacccgccgcagccttccaaaatgctgggattacaggcatgagccaccgtgaaatctctcattgctactccattctttctgcccaacttgacttagtagcttatattcagaactagcaaagaacaggaaaaagcaataaaaataataagtagattgatgagcaggtggactgaataattactttcagttatagaactcctcctatttaccttccaggttctaatttatgtgctgtattatttctaatacttggcattgttgctaatatttacattatctctaacttcaacaggaggcattattactccatttcagaggtgttaaaacttagcctgagagaggttgagttattgaacagagcaggtttagaacccagacctgtttgattccaaggccctgcccctttgaatgtcatggccttttactctgtgccctgagatggctcagtacttgcttagtgggcccaatagagtgctgaaggagaaagaagagcactggattaggagtcttatgtctggatgcaccatcgaagtggaacccaggcatgggcagctgtttaaatgatctccaaatggcccatggctgaatcatctccatcttcatgttgtttgccaacaaaacagacattctttgccacagttggtttttgtttgttcatttctctgatatgtcgaccctacttaatatagggaaatagaaaatttcctgattaaattaaatgagatcgaactcaagtctgtttggaagatggatttaggtggaggataaacagtagggtaagtttctggaaagtgaactcaaaatggcagcaccctggctgtcaaacctcatttccttttctcgtttccttttcatctcacatccccatctcataaatgctcatctttcctctgtgaactgactgatgtcaatcacatagagaacttcaaactccctcagagttcctttaaagagaatcaaccctaatgtggtttccatctagttaagtgcttgagtcttgtgtaagtaaacaacccaactttgacaccagaaagtttatggtatggttggggttgtggttggagtggaggagaagcaggtttaagggaaattttaagtaggagatttctcttcagaaaagaaaatgaagtctcggctgaagttgttctctatttcatcagtgttacaggcactccacaccaagctcaggttgcaccctgccctctgcactttaccttgggctacaggtctgggcaagggaagtcgtaacaattcattgccctatttcctgcaagaagatcaagtctagggctcacgaagccaaagaagagaaattcttctccagtgactgaaaagtcaccttcttcagctccttcaccttcactcttttctcttcagggaaagctgcccttctcctggggactggtatgttaccttatgaatactgggaattgggtagctgattttcagttttagtgtttgctgcaaggaagcttacatacaaatttgggatgcacttctagtagagtgtgctggccttcagggcataacttggaacactaatcttacctcgttttcacctgattcctcctacaatctcttttattttccataggtatcttaatttgatggattttttaacatcctgcattgtttgtgtctttgcaagctgtcttcaattgttctggaacaagtagtaagaactccatatatctgtcaagccacatatttaggtgtctgtccaacatacaataacactcttctccccatttttctgtaggaactgccttagccacaggaatgagaccccaagtcaacctgtttgcactatgtgatcctgcctgttgggccaacttaactgggattgaggtatatacctaacccaacctgagccacacaaattctctcctctgggaatttgaaattgggagtggcaaatgcctagtctgctaggctgggtacttgactatgtaaatatctgcagcattgattcttaaccctggctgccccatagaatcaccagggacactgaaaaaatactggtccatctctgcttattaaggaatttgaagatatatacattggatgtgacccattaattcttctcccagataaatctactgattggatttattatcatcattcctctaaagagtttgtgactggagcatatgaaatgtaacccttaaatttttctacctctcattgaaaattgttgcatagaaaggatgcaaaaccaaagtactttctgttcacttcagtcccaacatctgcaaatacatagatagaattttgaatgaattgaagagtctctcactaccattggactttatttctgataccattgttggtatttctgattaccattggacttattaggagatatatatatatatatattatatatatatagtgtatttgtaattttttgtagggtcatgttgcccaggctggtctggacctcctggcctcaagtgatcctcatgcctcagcctcccaaactcctgggattacaggcataagtcaccacacactgggccaacatacatttctttttatttctttttaattttagtttttttgagacagaatcttactctgtcacccaggctggagtgtggtggtaagatctcggctcactgcaacctctgcctcccgggttcaagcgattctcgtgccttagcttcccaagtagctgggactatagatgcatgctaccacacctggctaatttttgtattttttttgtagagtttcatcatgtttgtcagactggtctcaaactcctggcctcaagtgatccatccacctaggcctcccaaagtgctgggattacgagtgtgagccacgatgctcagccaacatacatttctttaacactttctatgtttaaggccttttgctggtgctgggggtggtgaagggaagggaagaaagtagatatctggaaagacctgaccctagggagacaggcaacaagcaacatggcagagaggaattaatggtcatattcttaggatatagcagtaaggaaggcaccagaagcttgctccaagcagtactagcaagttctgcttatcttgttttatgtcagataatctagtattccttccatttgtagaaataatcatggggtggctaaagtgtcattcaaattatgcccatgaagaggctagatgcaaccagcctccaagagcagtctcatttaaatctagataaaacctatcagatattccacatattgtaattcccatttgaattcctcgctcagcaccaattttctcagttggcctttcttgccctttctttttattgtttatctacctttgaaaataacaaagaaatggagtgggaaatggaaaattactctgttggaaaaactcaccttcttaaatgtgagttttcaatgcgtttagaaatatagtatagaatttctgagtgcacccagatatctcctcaagctagtgtaactgacagagctcccggttggagagaaaaacacattaacagtaatacttaatatttactgagtacttacacaccagacaattctgctaaaaggttagatgcaatatcttacttaatgttcagaataatccttgagtaattccatcttctctgtgttacagaagagcaaactgaggcttagagaggtaaaggaatgtgcccaaggtcatgcaggtcactaagggtggacactggatcagtacttcggtctgtccactagaatttgagaactttgtttttgatagttgctgtatcatttaccattcaagtaatgcctggcattgggaggcactcaataaatatttgttgaatgagtgaataagtgaatgactatctggctccagaagaaaatctctagcaggtgggtagaatcacatgcctaatggataaagcccctacaccatggattatgggcttgagccgggaggtgtccactttcagaaatgaatggtggcatagaaatagtatcccatgacccagaaaagctaggttcttatcttggctctttagctgtatgaccttgggcccatcatcctcatgcctttctgagcttcagatgtcatttctgcaagatgagagccctcagagtacctctgcattctcttccaactccaacagcctgtcagtcacaagaattttacacttcagaaattgatcttctggataaaccactccaaggacaaaccccaaatggtttccagctgtcagaagagattcattcccaccccaaatacggtaccaccttctctgtctctccagattccctactgggatgctgcatttagtgtttatttcttttactttcttttcttccccacttttcaacttttaattttgaaataattttttacttacacagaaagtaagaaaaaatttctgattacccttcttatagtttccccaaatgttaacatttttcatgccacagtgaaatgatcaaaatcaggaagttaacattgataaaatactattttctgacctacagtcctcaagttcaccaatagtctcactaatctacttttttttctgctccaagatccagcccaaatttacgtgttgcatttagtttgtcttgttttgtttgtcttccttgatttgcaacagattctcagtctgtctttgtctttcatgcccttgatgcatttggagtattgccaaggtattttttagaacgtccctcaattcgggttggtctggtggtgattgagttcagtttatacacttttactaaaaatatcacagaagtgatttgattccttattttgcctcttatcaggcactgtgtggtgtcaatttgtcatattactcatgatgctttttgttgctctcagttttatcatattctagatgttttatctaaaagtagagtcataataataatacctgcctcacaaagttgttgtgaagattgagtagaaaaaaggccatataaagcacaattcctgggatagcagggcttatcattttcatctttttttaagtatatcaaataattaggaaattatttgagtaaaaatgggagtttctgactgagctggagttggggcatttgcaaatccacattttgcctttgcattcactgctgcagctgtgccccctgaagtcaggagaattccagcaggcccggaaggatcacaactctcaatgtttctctgtaagggcagcaaaagtaactaaagtgtcatttgaatgtttggctattgtaagctcagtggcaggggacatgtctattcaaccctggatctggcctacaagatgtcaggtaaccttttcaagggcatgagatgttaatagtttttgaagtcaagttactagatattatgtttttgcctgggtaaaacatacgatgaatgtataaatctgggttttacaggtgacatctacatagagtgtttatttaactaactgcagttagtttatttaactaactgattgacatgtaggtattctgtaatatttttctattagtctgtgaataggcagtccaatgaattatttattgggctaacacatcctggtgctttttttttttttttttttgaacattctctattggaagtcatggttttgcttactcaattaaccttctcctgcccacatcttctctcttgaggagtaaactaccaaaatacaaagcagcattttggtgtacagaggaagggatcaagcttgctcaagatcttattctcctccagttgtaatctctccaaaatcacatgtagaaccttattttctaattgattatagggcatgagatgcacaaacaccaattcactatgcttttctagaaatgagtaaagctgcggcagagaagtaaagagagaaaacattcccctcgttctgccagattccagactcattctctgaagatagccaccatttgaagagtactaccaaggtactttgtagaacgtccctctgtttgggctggtgctggggatggcagtgacaacaagaactgttgaatcagaaagtatttttctattgtccctttaccctccatgctctctatagtgccattttttttccttttttctcttccccatatgctattgtggtcgttcaagtcgggcgtgatcgtggcttgaactagggtggttgaggaggagggaacgaacagtagaggtaagattcagaggtgtatttgagcttattgttgacaggatttcctgatagattggttgagggggtgtgagtaaaagagataagtcaatgataattccagggcttttttgtttgtttttttgagtcggagtctcactctgttgctgaggctggagtgcagtggcatgatcttggctcattgcaacctcagcctccaggttcaagcaattctcatgcctcagccttccaagtagctgggattacaggcatgcaccaccacgcccagctaatttttgtatttttagtagagatggggtttcaccatgtctggtctcaaactcctggctggtctcaaactcctggcctcaagtgatccgcccgccttggccacccaaagtgtgctgagattacaggtgtgagccaccgtgcccggcctaggtttttgttttttttttcctgagcaactaggcaactagatgggtgctggtgctatttactgaggtagggaacccagagagaagagcaaatttggaaagaagggctcaagagttttgttcggggcctgttatgtttgaaatgcctattagagaaccaaggagacatgtcaaataagcagtttggatatataagcctggaatttaggaaagtgtagtggaaagaacacgagattttgtgtggtacatttggaattacaatctttttttttttttttattttttgagacagagtctcactctgttgcccaggctggagtcagtggtgtgatctcagctcactgcaacctccgcctcccggattcaagtgattctcctgcctcaggctgcccatgtagctgggactacaggtgtgtgccaccacgcccggctaatttttttgcatttttagtagagatggggttttaccatgttggccaggctggtctcgaactcctgacctcgtgatccgcctgccgcggcctcccaaagtgctgggattacaggcatgagcccccatgcccagcccagaattacaatctttttataagactttgactatgtatttaacctctctggctcacaattaacatatacatcaattgtaaattatattagtcatatttcagttatctattgctatgtaacaaaccacaccaaagtatagtggcttaaaacaaaaatgacctattacttttatcatttatttatttatttttaagacagggtctcacttcgtcgcccaggctggagtgcagtggcacaatcttggctcactgcaacctccacctcccaggctcaagccatcctcccacctcagtctcccgagtaactgggactacaggtgcataccaccacgcccagctaatttttgaggttttttttaagagatggggttcaccatgttgcccaggctggtctcgaactcctagcctcaagcaatccgcccactttggcctcccaaagtgttgggattacgggcgtgagccaccatacctggcctaatgatttattacattaaaattattctgtgggttgggatttagctgggtggttctgctggctttgcttgggtctcttattcaacaataatcagctgagagcttggctggggttggagtgtccaagatggcttctcactctccagagcctctctccagttgacctctcatgatttagtaatttagcctgagctttttacatggcaacatagatcttgagaagacaaatccaatgttcaagcacttattcagcctctacttgtatcatgcttgctaatgtcccacaggacaaggcaaatcagatggccaggcccatggtcaatgtgggagagggtataatactggaaggtgttattaattgtggaccaccattaattgagtctaccacagctgacttgatcaggtttttgtgaagatgaagtaaggtaacacatgtaaattgactgccacatggtagattctcaataaatattagctattattattaagacatagcttcaaaatcaattcccaggacctgtagatattagtcttattttactaatatacgtataggagaagaaaatgaacatgctttcttgtttctttattgttttctcccgcagaagtagagctacggttctttttcctttgcactcaattgtactgcctaatagatgttctatgattatataaaatttggtgaataagtaatctactgctcttgttttcgaaaaataaaaattcccttttaatgttctcattaaaatggctttgaaaccaaagtttaaaatctgaacacagatttttttccaataattttcccaaatgtaaaatttgtatttgccaatttttaaattttgtaaactaagtctattgcttatttctaactgtaattctgctacaatttctttctttctttctttctttctttattctttttttttttttttttttgagacagagtctcactctgtcaccagggctggagtgcagtggcatgatctcggctcattgcaacctccgcctcctgggttcaaacgattctcctgcctcagcctcctgagtagctgggattataggtgcctgccattatggacagctaattttttgtatttttagtagagacggggtttcactgtgttggccaggctgctcttaaactcctgacctcgtgattcacccgcctcggcctcccaaagtgctgggattacaggcgtgagccaccgcgcccggccacaatttctttgctatttaattttcttctacataagtcacatcaaggctgctataaatattttggtaataaaggaacaaatcactcatgctttagccatagctctttacctgcataaaaacagcacaaagtggtgcattgtttagacagatgtgaggacatagagatgatgtgcatgtgtgtgtttatgccattctgggcaccagaaacttgacgatagtggtcacataagggaactaccaagatatcttttgtatctctatataacaatacccacaggagttctgaagcttgggacttttcgaagaaggcaaaataattttttagaatgattatactttaactactactaatatgtatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgtgtatatacacataacatttatgtatgtgagtatatacacataacatttatgtatgtgagtatatacacataacatttatgtatatatacatatgtatacacacataacatttatgtatatatacatatgtatacacacataacatttatgtatatatacatatatatacatatatatacacacataacatgtatatatacatatgtatgtatatgtgtatatacacatagcattttatgtataccaacaaagaatactatttaggagagagttctgttatcatttttaaaggtgagattgcttagccatttggtatttttctccttgcattgtacaagttctgtagattctgtttagattctggccccaaatcttaagcctacttgttctgagaagtcacttctttggggtccttaatccctatgctagaatatttctggtctgtccacaaatatgattggcagaatgttatctccttattgagcctctgtttccctgccattgtggttctacctgaccttctgcatcctgtatatgtttctgcctatgtgtggccttgggaaggataatttagcttctttcctttgacaagaagagtaacttctttgggatccaaacacaaaatgctccattcactggcagaagctggattgtcataacatgtcttgtgtaacactactaaataccttttcttatcacagcagtgcaagtttgcacctgttcagccacattgcatgcagtgctgtctgggtaacaccagtagaaggacacaaaacaaaacaggaacgaatcaacttagagtctcagttgacttttccctttctttctgaatttttggtgccattttcacaaaactcatggtttactttattcctatgaatcatataatttcctttcttcactttacttgtagaaatacattacaatattattttcttttttaaaaaaatatggaatgcttcaagaatttgcatgtcatccttgcacagggaccacactaatcttctctgtgtcattccaattttagtatatgtggtgctgaagcaagcactacaatattatttttaaattgaaaaatcataggctatgaagacatatgttttccctttgtctcagaatcacacagccctcatatcaatttatgcattttcctaaagtgaaaggacattgatcaattttttgccatattgttatacaataatacatggaatcatatcagtcaggataatctcaattatgcttcagtgataaccagccctgaatttcagtgatgcaataagatttatttcttactcatgctacctcccagtgtgggttgactggggagccaaggtcatccaggtctcttagggccccaggctgacagaagctccatctcaattcacactctcatcatcacacacgcacaaaatagggaaatgtggcaaattgtgcgctggctcctaaagttttgggccagaagtgacatgtcactttattcatatttcattggccaaagcaagtcccatggtcaagcataattttcaaaaggagagaagagtccaaacctgttgtatttccaaagggagatgaactggaatatgtgtaaacagccccaatgaccatggtagtaccttagaaagaattaatctcaccagaaatacaagtaattaaaaatatttaaatatataaagaaagaaaacaatagtgctgccaagtaacagtgcaatagtcactctcttacactgattatgaaatatttctgaaaagcaatttagaaatatgtatttatcaagcgcctcaaaaatcatccataaactttggaccttatttacactttcagaatttagcttcataagaataaaaattgtaaatatctaaatgtctactaaaggggaattggtaaatctactaccatagcacacataatgtaatattatatagccactaaatatcataggtttgaataatttaaaatggtaaaatgctcaggatgtaacgttaggtgaaaactatcagggtataatagtgttttcaatattaactcattaaagaaccttagtggtagttatctctggcaggtgggattagggtttttatttttcatttttatacctttcacacattctaaaataaacatatacatttttaaagaaaaatacaactgaacttaaaaaatactcaacacttctgttttatagctttattgaagtataatttatataccttgacattcatccatttaaagtgtacagttatatgagttttagcaaatttatacagttatgtaaccatcaccacaattaaaatttggaatactttcaacatccccaaaaagttctctcattcccttttgtagttcattcctgctcacaccccagcccttcaatctgttttctattgctgcataattttgctcttgttagagattttatatgaatggaactgtatgcatatgttattttatatctgtctcctttcacttagcatgatgtttttgagattaattcatgttgttacatgtatcagtaattcattctttttattactgagtagtgttctattgtatggaaacacaatattttgcttatccatttagcagttgatggacattgggttgtttccagactttggctattatgaataatgatgctatgagtatttgcatacaaatctttgtgtggatatatatttttatttcccttggatagatatctaggaatggatttgctgagtcatatgggaagtgtaagtttaattttttaagaaactgccaacctgtttccaacatggccataccattttacattcccaccagcaatgtaagagagttcttgtttccctagattcttgccaatacttggtattggtagtctttttaattttagccattttgataggttaaaaaatatctagcacgtggattgttccctcacaggcatttagctggcagtacggttgtaagctctattcacatggtagctcaaagctgggatcttgagtttccatgcttgcaggcctccagcatcctaatcaaaagtaaaggaagtcttcatcaacaaccaaaggttcaactctttgttattatagacataggccaagtaagtttcttacagtaacacaacatacacaactcaacccacatacaaactgaccagacttttgtgtttcttacaaatgtgtgtgttggggtactgcagggcaaggggaatagggatagaaatacgttgtgaacttttctcttttgcatgaaagctaattaaggaacaggcatgccactgaatgtttcttttccttttttttttttttttttgacaagacaaagtgtgggctgaatatataatttgaatatatataattatttcttgataactataaggacaagaaacaagtgctgcaggacttatggaattctttggtatgggatgtgcctagagaaatggtatactcatgtgaaagaaaggtaaaggagaaaaatcccaagagaaactctgtagcataaggtttctgttcagtgtgtggggagtccgaatgtgttgttaaggacactgtgctagaataaaaattgtctgggttccaatttaggtctttcatttatcagctgtgtgacctcagatgagtcatttaatgtctctggcgtcctcatctgtaaaatgggtgtaataatatctgacctacctactgcgtgacaatcttggatccaaacagcactatagaaccatttttatagagcactttgccttatttgtacacagtacatttgtacttttcatttaatcttttatcttatgcaatcaccaaataacccagtgaggtagcaaagcgtagttattatctccatggtacagatgactaaactgtggctcagaggctttggaatcacaaaagaaagacttctagttccctggccaacagaatattattttgtgctatagttcttataggttatgttacatcgtgctataattcttaatattgtaattagaattgggccacacatttgtttatgtgttgtctacacctgcttttgtgtgacaacacaaaaggtagagctgagtcgtagcaacagagaccacatagcgtgcaatgcccaaagtatgtaccaactggctctttaagaaaatgtttgctagcctctgatttaagtgctttttactatgtgtattaactcactcaatcctcctaataatcctacgaggctggttatattaggcattaagggaaactgaggcatagaaaggtagagtaactagatcaaagtaaaacagtgagtaaatggaggagccgaagtctgaacccagatagtctggatccaaacccaatgcccttaatgcctttcattactggcctcggtgattcctatttggctacatctcatttggtcgacattcactgagtaactcttagtggccagacaccattctagggattggggctagtatagaatacgctcttatgaagctaacattccagtggaggaactaaaactattatcaagtgaccaaataaatgagcaagattgtttcagagaatgaagtctgtgggggaaaataataggttagagtgatcagagacagagaactgggtggataaagggggcaggagagacgttgctagaaaccactgtgtacgttgaacatattctgactctgatcctcccaatggaagacccttattcttattgcttcttcttctttgtctccccagcccctggcacagagtgagcacttaaaaaccacctgtgtacatatgactgacctttccgtcacctgccttcccattggcctcttcctgccccttcatccacctttgtgtttgaatattcattcacatggcttgttcttccacaccaaattatgagcctctaacagtcatgatctctgactctaagtcccatagacttagtccagagtgctgcacagagagggacctcaagaataatttctaaataacattttagaatcagctcttggcccgagtctttcaaaaatagccatgtacaggttgaaattttagttaaaactgcatgtgggccatagttttatctcccttatctgaggtaatagggaaggaaccacagttatttgcaataacagatcctacaccagttctctgtgcttctctgtgagtggccaatggtacttccacactgctgctctgtttatccagccctgacccctggtgaatccggcctgcctgtgggttttggcctccaatcagtatataaaaggtcgggaggaaggaataacccaagtccccataggtaatacatgaatagggtgatgcagtagtggctgatgaggggagttacagactgataatgtaaacttacatgaagcacagctttccaggattaggtagaaattccatctgtgtgccaaactagccctttacaagcataagcaaacccagagtcttcgtgagatgtaagatggaaaaatgatcaaatgcctgacaagagcctaacatgggcatttctagctctggcttctgccttgaccttgtatgacctttgcaattgtcctaggcaggcagacttcatgacacctgtcccctgcagcaactgtcaagtcagccccacctgatttcactaagctggaagccggatctgtccaacactgccagctgttacccacatttgcttttatggctttcctttgctcccatctcttgtgtgttctcctcttgcttatcctcttttcccctctctttacttctatgaatagtaattttcatgctttttcattctaactttattacatctgcaaagtccttatttccaaataagatcagggtttaggtctagacatatattttgggggagatacactgaacctactgcaatatgctttcgttttatttaggaatgtaaggtgacatctaatcaacatcatgctgacatatgggctgtactttaaaaacccaccttcagacaaagaaggaaatgaatttggtgagatggtaggagcctgaaaggtgaacatgcagtggtgaaaactggtcttatgatgccttcctgacaattgcagacaaatagaattggcttattccatatttcctcttctgcacattttggaatataagatagaatcataccttgccagaatttgggatgtttcctctagcaatttgcccattgcaatcttttacttattgagcatctacaatgtggtagaccctatgtaggtactttcatccctaaaaagtgaggtagagtctcttatccctaatttgaggctcagaaaggttaagtaataacctgcctatgaaaacacagttggcaagtggcgtggctgagaactaaactcaatgttatcaatctctttaacccactttctttggttcagacattaacacttgtattcattactgtcatgaagcaccaagtgttagaccttagtgataaagcagggaaacctggtggtcatggctccaagtttacactgcagaagtggaactctggaagaggtacaggaatcaattacatgaaaagtcaggagaggagcatcccatgacttcacctcacagagctgaactgtctgaaatgctgccatttttagcatgggtgatatctattttgtcatttatgaacaccttaaggatcaatggagataggttatccatggagggcaaggactttgtcatttaagatgacttaggatccacacttatccacatcccaaggactcaggagctactactctgttgctagctttttttaacttaacttcctaagactgcaaagcagagatgggaaacacctgggttagttcaagggctgtccaagggacaggttgagtgtacttaaagttcaaaactgattatgattgtgctttgaaaatagcaacttcgttcttccataagggttaacatttatatcccacaaatataagttgctaattgcattcattttagtatcaagatacttccaaaggagagaaagaagtagctaaaaatagcttgggctggcaaatatgtggcacattgttgagaatgttgtgatctttccatgtgtggtgatctcagtaaacctggacctacttctgggttggtgtttccaatctgaaaacctttttattttttttaaatagagacagggtctcgctctgttgcccatgctggagggcactgaaatgatcatggcacgctgcagcctcagcctcttgggctcaagctatcctccttccttagcctccagagtagctgggactacagaagtgcaccaccacacccagctaactttttaatttttgtagactggatcatgctatgttgcccaggctggtcttgaactcgtagactcaagtaatccttccgcctcagtctctcaaagtgctgagattacaggtgtgagccactgcacccggcctcatctcaaaaacttttgatagccttccagggagtggagaacacagtccaaacatccttagcctggccttcaacatcctatacagtctggaccctacattcttatccagctcagtcttctactacatcccctggctcccaccaagcctgtacataagtcatcactgtcagtccagaccctcctggttgtggccagtgtggtccagctcctaacccttgctcagcctctgccttctgcctgtgtgggagatcgtaaaaatggctgcaattattatcctcactgtatccacaatcctttggaatgtgacttcatcaagaagtggagctttttcctaccccttaaacctggagtggtcttgtgacttgctttggccagcagaatggagcagaagtgatgcagtgccagttctgagcataagtgttcagaagtcttgcttactttcgttcactcacttggagctctggtgtcaccacagggacaagccaggctaacctagtgggatgataaggcccatgtggcacaggctgggcgcagtggctcacacctgtaatcccagcactttgggaggccaaggtgggcggatcacgaggtcaggagatggagaccatcctggctaacacagtgaaaccccgtctctactaaaaatacaaaaaaattagccgggcggggtggcgggtgcctgtagtcccagctactcaggaggctgaggcaagagaatggaggcggagcttgcagtgagccgagatcacgccactgcactccagcctcggcgacagagagagactccgcctcaaaaaaaaaaaaaaaaaaaaaaaaaaagactcatgtggcacagtcaccctctccctcaacaggttagccatccagccagtgatggacctgccaggggactgcagttgcttgagtgagtgataactgctgaagtgagatcagccaagcctagcccagagtagcagagctatctctcttatctgtagacaggcaagcaaaaatcaatggctgttatttgaagtcacttagttttggcgtgggttaatatgaaacaagagataactggtacactcttgaatttccttcccattcatccattaaacatgacctaagagtctgctacatgacttgatctctggtcgacattgggggtttagcaccaatacagactatctccaaggagttcccatttccttttgttgggcctttgaagtccccttctttcaaggcagccaaagatggtcaaatcccacttcccagatgtcttctcagatcttcccagtcaaaattgatctctccctttctcaatcccaattgactgtctttatatcacttctctggattctttctcacctagaaggttgcaagagctgctgattggcctctgcatgtctaatctgctcttgaatttgtccttctcagccttaccacagtgagctttcaaaatgcaaattatattatgacccttggagtgaatctcctcactgactgtcagacccttgaaaaagtcccacatccaccttcgtgctctgtcgcctgaacacttctcctgtctcatcttccatcttatatttactgtctgttaatagttcactctttcctgttctctcttctaggaatgttctcggcacccaaggctgactgatatgcttttatttaccttcttaaattcagttgtcacctcttccaggaagtctttattgaactctgctgcttccctgccccaccttctcatttctgtgactgtaatactgctactgtgcgttattttaatttcttatgtttacatgtctggagacaaccatttttaaactcaaggcccaggtattaattttatctgtacatctagctatcccttaggcaaaatcttttcacttagatgatactcaaaagtgtcttttatttatttttttttatttaattaattaatttatttattttgagacggagtttcactcttgttgcccaggctggagtgcaatgatgtgatctcggctcactgcaacctcctcttcccaggttcaagcgattctcctccctcagcctcccgagtagctgggattacaggcatgcgtcaccatgcccggctaattttgtatttttagcagagatagggtttctccatgttggtcagcctggtctcaaactctcgacctcaggtgatccacccacctcggcctcccaaagtgctgggattacaggcatgagccaccgcgcccagtcaaaagtgttttttaaatgaatgaacaaatcaataaattaaggaataaagactgcctttacaattacctgcctggtgccctgaaagaataattattcacatctacacagtcatgtatactatctttgtacaaataaatttcctgagagaaaatttcacttaggagacagagaatagaatcaaagtgtcttggagaagatgtgaagaaatgccaattgtaacagaagattgatagtctgaaagccgaacataatctgctatccaattttatatgacccgtatgactcttagatcactaggtccagtctagatattttttaaagaaaggaattccaatctttttgtttaatatttctaaaaatagtaaagaaaacctgttttatccaagtaatattttatattttatttatttatattgtgatccctaaatgttccacaccacgcatattctggaatctatcccaacaccgccctcgcccaaagaaaactatcctcagccaggagaatttttattcttctttctcgatattcttcactccctccttcccagttgtcatatagatcaacttaaccttttaaaattatcccttactgacctttctcccactagtttttcacactatcaaatcataaaagcccaggaatcatgtggcagaaaaatctagctttctaggaaaggaagggctagaggagaaacaatttcactagaaagagctagcatttccttaacaagagcaaggtgggtgaatttagggacatttatacttatattaactttaatacacccactagacttaattattctatgcctactttgtattatctgatctttctagtccatgagttttcactagtctataacaaaatgagaaaaataaatgattgtttttttttaattattaaaacaaaattttagaacagtattttagtctagtgtctacttttggggggttttcttttctttaacaaaatcatagtgatacgacatagttttgtaatgttttatttggcaaaatagaaatttggcaaacatgtaagttcgtagtttaaaaaaactttttattagtctatgaaaccctaaaatatggtaacaatcaattcactgtttgttgaggtttttagcgggggagaaaaaggccttcagttgaggaataagagacagaagagaataggtgtcctaaattatagggggtgtcctaaattatagtaaaatatttccagtttccagaacctgtttttactctttgctgtgttcccagcctggagttctcaacccctgtggacttttaaaggtactctagtgagagttctcaagctgttgtcagtatttcaacaatcttaaaaaaactgtcacttgccagaaattagcctgtatagattatacagcaaatttctctgcttttggctaaaaagataagaattcaatatagtaacaagaattatcacatactgtttagaaggactgattaatatctagaggtttattaagaaaaaaataaaaattattgattaaagtgtttgatttgaaacagtttggctgtttctcaagatgttaagatacagaattaccacgtgaaccagaaattccactgctaggtttatacccaagataactgatagcatacatccacacaaaaatgtgtgtataaatattcatagcagcattgttcatagtagtccaaaagtagaaatagttgaaggtgagtggataaacaaaatgtggtatattcatataatggaataatatcctgtcaagaaaaaaagatgaagtacagatataggccacaagagggatgaaccttgaaaacattatgataagtgaaagaatccagacagaaaagaccatatattatatgattcaatttatatgcagtatccagaatgggcagatccataggcagaaagctgatgaatggttgccagggactgcggggagaggggaatggggagtgactgctaatgggtttcattttggtgtgataaaaacgttatggaattagatagcaatgatgattattactttgtgaatataattaaaaaatcactgaattaaacactgaaatataaaatataaaaaacttttaaaagttacagttgttttgtgggtcatgggtagtagtatttaaaacatgggtgcacaggtgcactaaaatctcagaattcactactatataattcatccatgtaaacaaaaacctcttgtaccccaaaactattgaaataaaataaaaataaaacacgcatctatggaaaaggagtaaagtgaatccttggaaagaggtttgagaaatattgccatacacagcttacaactgtgtgaaaagtcagctgttctgtatcctgactttactcacatccatgcaaacaaggtggcattcacattacttctcacagttcaaaagtttcctgccctttcctatgtaacatccttagtacccaaacaggcttctctgtgccagccacaaggagttacagaaagaaaggagaaaggggtcaaatcctcctttgtcctcatgtgccacctggtcctgaaagccaactgcttgttccccagagaatcacagaaaatctttgtgagtttgagttattgacctcccacgtgtagctgctgtaccctcttcccatagttcagatctggttgattggtccaacttgggattcaacttgggctgttcccctctgtccccacccatctctgcctccacccatctctgcctgcaggactttgttactggagtctgatccccgtttgtcaatcagttgtagctgaactctagtttgagcttgagtttaattaagtttaattcaaattaagtttaattcaacttaagtttaatttaacttgagttcaagctcaaactagagctcagctacaacttctcttgcacttctacagtatttcattctcaagtgatctatccacatgaaacatttagaagccaaggtgaaaaataaaattaaggagtggatttctaaagacttggctgtttgggactttcacatcatatagttcctgacaaaatggtggtttgccaccatgtgaaggaaaggaatgcttgctacagtcaaggattgtttgaatttcccagaggaacataaagtgtcagacagtacagggatggaaggagcttcacagaatgtgtagtacgatgtctcagcaattgcaggactcacttctagtgcactcatttttttcatggtggtttttttctttttctttttttgttgttgctgttgttgttgagatgtgggtgcggggtctcactttgttgcccaggatgctcttgaactcctgagctcaagagatcttcctgccttggcccctcaaagtgctgggattacaggcatggaggcaccatgccaggcacttctagcatactcttggctgatgcccatcaagtctcaacaggtacacatctcaggaagaggcactgtcctctttcacattgttatataacctttcatgggtccatgatttcttctcagttaaactgtcactaacaagatcatgcttacatagcttgttttattttatttttaatgtcaatactgtaggaaaggcattttttatctccattttaccttggaagaaacagagtctcaaagagtttaaatgaattgcctggagttgcagactcaggattcaaactgagcttctacctctaaacccaatgttatttttactctacactccagcctgctagagattttaaaagatgcaaatcatatatcatgcctttttttgtacaatgctttaataaatactgttttagtaaattaattcatttcctgctgataattttgcttagtatatagagactagcatatagtagaattatagagaaatggatttgaacaccctcttgactacttgcaagatctttgatcttgaacaagtagcctaatcttgcaaagctttaattctctcctttgtaacatgatttgatgtaaaatttatatttttttgctataagtaaatatatatatttgctagtttctaaagttggtccctcaatgagccacacctcttagtatctacatctttctataagtccctcctctggggttgatctgtgactcacgtttaaccactagaattgatggcagtgacttagcgtgacttctgaggctagatcataagaaaccttacagcttccacctagttcccttggaacattcagtctaggggaagaaagctgccacataagaagtctgttgaataggagtggagagacagggcatccttatcttgtgctggttttcaaaaggaatgcttccagcttttgcccattcaataagatattgtctatgggtttgtcataaatagcccttattattttgtgatatattccatcaatgcctagtttattgagagtttttaacctgaagggatgttgaattttatcaaaggtcttttctgtatctattgagataatcatgtggcttttgtcattgcttctgtttatgtggtggattatgtttattgatttgcttatgttgaaccagccttgcatcccagggattaagccaacttgatcgtggtggataagctttttgatgtgctgccggattcagcttgccagtattttactgaggattttcgcatcgatgttcatcagggatattagcctgaggttttctttttctgttgtgtctctgcaaggttttggtatcaggatgatgctggcttcataaaatgagttagggaggaatctgtctttttcaattgtttggaatagtttcagaaagaatggtaccaggtcctttttgtacctctgatagaattcggctgtgaatctgtttggtcctgggcttttttcggttggtaggctattaattactgcctcaatttcagaacttgttattggtccatgcagggattcaacttcttcctggcttagtcttgggagggtgtatgtgtccaggaatttatccatttcttctagattttctagtttatttgcatagaggtgtttatagtattctctgatggtagtttgtatttctgtgggatcagcggtgatatcccctttatcattttttattgtgtctatttgatccttctttcttttcttctttattagtctagctagcagtctacctattttgttaatttttttgaaaatgtcagctcctggattcaggcaagcgaaagaaataaaggatactcatataggaagagaggaagtcaaattgtctctctttgcagatgacatgattctatattcagaaaaccccattgtctcagccccaaaaccccttaagctgataagcaacttcagcaaagtctgaggatacaaaatcaatgtgcaaaaatcacaagtattcctatacaccaacaatagacaagcagaaaaccaaatcatgaatgaactcccattcacaattgttacaaagagaataaaatatctaggaatacaacttacaagggatgtgaagggcctctttaaggagaactacaaaccactgctcaaggaaataagaggggacacaaacaaatgggaaaaaattccatgctcatggataggaagaatcaatattgtgaaaatggccatactgcccaaagtagtgtagagattcgatgctattcccatcaagctaccattgactttttgcagaattagaaaaaactactttaaatttcatatggaaccaaaaaagagcccatatagccaagacaatcctaagcaaaaagaacaaagtcacactacctgacttcaaacaatactactaggctacagtaaccaaaacagcatggtactggtacaaaaacaggtatgtagaccaatggaatagaacagagacctcggaaataacaccacacatctacaaccatcagatcttcgacaaacctgacaaaaacaggcaatggggaaaggatttcctatttaataaatagtgctaggaaaattgtctagtcatatgcagaaaactgaaactgtaccccttccttacaccttatataaaaattaagcccaaacccatataaacccttgaagaaaatataagcaataccactcaggacataggcatgagcaaagacttcatgactaaaacaccaaaagcaattgcaacaaaagccaaaattgacaaatgggatctaattaaactaaagagcttctgcacagcaaaagaaattatcatcagagtgaacaggcaacctacagaatgagagaaaattttttgcaatccacccatctgacaaaggtctaatatccagaatctacaaggaacttaaatttacaagaaaaaacaaacaaccccatcaaaaagtgggcaaaggatatgaacagacacttcacaaaagaagacatttatgtggccaacaaagaaatgaaaaaaagctcatcatcactgatcattagagaaatgcaaatcaaaaccaaaatgagatactatctcatgccagtcagaatggtgattattaaaaagtcaggaaacaatagatgctggtgaggctgtggagaaataggaacacttttacactgttggtgggaatgtaaattagttcaaccattgtggaagacagtgtggctattcctcgaggatctagaaccagaaataccatttgacccagcaatcccattactaagtatatacccaaaggattataaatcattataaagacacatgcacatgtatgtttattgcagtacttttcacaatagcaaggacttggaaccatcccaaatgcccatcaatgatagactggataaagaaaatgtggcgtatatacaccatggactactatgcagccataaaaaatgagatcatgtcctttgcagggacatggatgaagctggaagccatcattctcagcaaactaacacaggaatagaaaaccaaacaccacgtgttctcattcataagtgggagttgaacaatgagaacaacatggacacagggagggaacaacacacaccagggcctgtcaggctgtgggggtaaggggagggagagcattaggacaaatacctaatgcatgcagggattaaaacctagataacgggttgataggtagagcaaaccaccatggtacacatatacctatgtaacaaaactgcatattctgcacatgtatcccagaacttaaatttaaaaagaaagaaagaaagaaaacaaggaaatctgactgtcctgagactgccatggtttggggaagcccaagcttgcctatggagatgacctggagaaagaagagataccaaggcagcccctagatattacaactaccccagcttaggatgtttactcatgccagagagaagtaaagaagccatcaagaatatcaggcacagttaagtcatcagatgtctgtagccccagttacttgttacacctgctgcctgaaatgccaagagagaaccactcagctgagcccagttagcccacagaatcatgacagaaaataaggaattattgttttaagtcactgagttttagggtggtttgttgaacagcaatagataggcagaatacacgaggatgataatcatacctaccatgtagagatggtgtgaagattacatgagataatgtacttaagtgcccagcacatagtgggtagacaataaattgcagattatcattgttgttatattttattctaagcctccttgaagtccttctgtaagatagctaactcatggatctgtcccacacatgcatattttaaaactctgagaacaaagagagtatttgccctgtggaaggtaaacctaaattagctaaaagccctagggatttacttctggatttcctgccctttgctattagtcttttcctctaactctttgtatctggttttgttgggctggtttctgcccactacagtttcagcctgggactaggatcttatctgctttattgagggtgttcctttgatccactaacataaaccacttacaattaattaccatgtacagctgtgttagttgtctgttggcaaaaattttttctcttattcttgctctctttctaaagtagaaaagaattttttaatccattgatattaccaaagacatttattttttatttttttgttttgttttatttattattattattattttttgagacagagtcttgctctgttgcccaggctggagtgcagtggtgtgatctcggctcaccacaacctccacctcctgggttcaagcaattctcctgcctcagcctcctgagtagctgggactacaggcacatgccaccttgcctggctattttttgtatttttagtagagatggggcttcactatgttggccaggctggtcttgaactcctggcctcgtgatccaccagcttcggcctcccacagtgctgggattacaggcatgagtcaccgtgcccggccccaaagacatttattaatcaaaggaccagaagctcttagtctggaatatttcaatcctaatacaatctaagcacacatgttcctgtgcttttaggtgcatacaaagatatattcatgatttttccaggtatggtgatcaataaaactgagaggacctcaagactcacaaattgatgatgaagttgggcctagatgaactaatgaatttttttttttttttttcagatggattttcgctctgtcacccaggctggagtgcagtggtgcaattttggcttactgcaagctccgcctcccagattcacgccattctcctgcctcagcttcccgtgtagctgggactacaggtgcccgccaccatgcccagctaattttttgtatttttttgttagagacagggtttcaccatgttagccaggatggtctcgatctcctgccctcatgatccacccgtcttggcctcccaaagtgctgggattacaggcgtgagccacggcgcccagcccaaactaatgaagcatttttaaaattttaattcccttcagatcctgaacaagcattttatttatttatgtatttatttatttattttagagataggatcttgctctgttgcccaggctggagtgcagtggtgtgatcatggctcactgcagcctcaatctccttgggctcaaacaatcttcccacctcagcctcccaagttgtttggactacaggcatgccccaccatgcttggctaatttttctattttttgtagagatggggttttgccatgttgcccaaactggtcttgaactcctgaactcaagcaatccttccgcctctgcctctcaaagtgttgggattacaggcatgagccactgcacccagtctgcttgtattttttgttaaatcaggaagaattttgtaaaggacatcaattgaataatcatgtggcttggctttgataattatatctgatacttttatggtggtttctcatttcaaagagtcttccaatttgagtctcaaacctgccctggaagaaattcaagactggaattttcattcacatttcacaaatgaggaaactgaagtttaaagtttaaaggcctgattttttccaggcctcccacctcatagtctaggacggtttcatgacaataaagtggcttttcttaagccagcaagcaagttccaacccagtgaaagaaagaaatagaaatgtcatggacatagaggtgagataaaacctttcatgaagtcattgtgatagttaatattgagtgtcaacttgattggattgaaggatgcaaagtattgttcctgggtgtgtctgtgagggtgttgacaaaggaaattaatatttgagtcagtggactaggggaggcagacccaccctcaatttgggtgggcaccatctaatcagctgccagtgtggctagaataaagcaggcaggagaagatggaagagcagactcactgagtcttacagccttcatctttctcccatgttggatgcttcctgccctcgagcatcagactccaagttcttcagcttttggactcttggacttaaatcaatggtttgccaaaggatctccagtctttggccacagactgaagcctgaactgtcagcttccctccttttgaggttttgggacttggactgatccacccactggcttccttgctccttaacttgcagacggcctatgtgggactttaccgtgtgatcgtgtgagtcagttctccttaataaactccctttcatgtatacatatatcctattagttctgtccctctagagaaccctggctgatacaggcattaaggagagattttttataatttttaaagaactgcccaagtgaaatggatattcttttttatactatgggtctacacaattccttacctataattcttgcagatgtatgtattttgaaatttagaatattccagataaatatttgaacacacacacatacattccatcagggaacaccttataattaaacatagtaatttttgcagcataacatgtaaatattcatactaaatgagataaagattgtacagattatgaatagtttcagagtttattgccaaatgagcttgctacagatctataagcaaaacaaaagaaaaattttttgttgggactagatgaactaatgaagcttttttttaaaaaagaagcatttttttcagagatttttggactttagaattgtggaaaatagattgtggaattgcattcagactatgaaactgatcattctctcagtgttttctgctgttgggaacatcacttgctcgcctagtggggtttgttctcaaactttgtgcaggaaagatgacttgaacagagtttacacctgctgtcctgtgcttccctaactggcatgctcacaaagaaagggcctcagctaagtttgaagtatggtttcaggctttgggaagacaagccagtcaagccagctaataaactcttttatccaaaatccctaagggggaggagaaaaaagaaaaagaaattaaaatggaatagcagcctgctttcaacttcatgagaactgatcacacaaggaagccagaggcatctcatcaagaaagtccaaatttgatgaagcaatttcactctggaagccttagactagacagacctgcaatgaacccattataaggtcatcaagatgggtgagagaagtgggatccgtacattaatattaatggcagtaataactgtgataccgctccccatttcagtctctgccgggaagaaaagcttgggccctttcctacgccaagaggagacagagaacattttccaaggacacttaagacttgctgtccctttacaattggccttttttcccagaacacttcacatggagcagcgtaagttttgctgtctggtcctcttcggtggaaggtcattttgtatccaaggtgacagctctctctggggataggtatgtgacgtggaggtagataagtggatggtgtggggatgagcccagggcccatggggcccttaaggtgatggcctgcaccctgtggtggtctgctgaaagagcagaacactgctgctgctgctgctgctgctgctgctgctgactcagtgtgtgactcagtgtgtgccgtgatatctgagcaactgcccagcaagcagcagaaggggaaaggtccacgtctgataaaggagacaggaaatgcattttgaacaaagcttttattattttttttaattctctgctctcattcattttccacatactttatccacaatgacctttgaaatctaatcaattgtttggtatcttccttgttatgaaaaaaaaatatcaggccactaattttctccattctaacgtcttttgcagaatgattcccttctcttttggtgcaactgattcgatgcaatttttgaaaagaccgtattttcagcacttcctgtgtgtgcagaactcttttttctcttgagacggagtcttgctctgtcgcccaggctggagtgcagtggcgcgatctcggctcactgcaagctccgcctcccgggttcaggccattctcctgcctcagcctcccgagtaggtgggaatacagcctcccgccaccatgctcagctaattttttgtacttttagtagagacggggtttcgccttattagtcaggatggtctcgatcttctggtctcatgatccacccgcctcggcctcccaaagtgctgggattacaggcctgagccaccgcgcccagctgcggaactctgatgccacagatacctgggtttgaattccaggcccatcattttctaaccatgtgaatctgggcaaattacttagccatcatgagatgtaatttcctcaattgtaaaatggcaataatatatgagatgtttgctgtgagaatgaagtgaggtaataggagtgcttattacaaaacagacacaggaatagtttattataactagatgctaagaggaacttaaaggtaaataaaacacatatgcacacacatacacacttctttaatgcaaggaaaatatataaaggattttggaagtgacttgagagcatacggtacagagaaattgaaccatacagtggagagtgtgcattagatccaggcctgggcaaacacatggactatcaataggctgggtaatgggagtgaggagaatgaggacgtaaaggatgcttctaggcagaaaacatggtgacacagaggcaggaaagaactgaggaggaattacagaaaaagacccagacttttccagtaccataaggattgaaagtatcctttctcaatagcctcacaactactcctttcattatagaagtaagtgttctgatttgaggtttgaaaaataatcactctagcatttgtttgagcattgcaacacatataatcagggcgaggttaggagggagaagagagtgggaagttagctacttgagattattgagggctttgaatgtcacaaaagggaatgagactttttgcatgtgttgtatagtgaggagtccttttggacctgagtggcaccagtttcagaaggttacaccatcgatgtacagattaattagaagtgggatagggaggccgaggcgggcggatcacgaggtcaggagatggagaccatcctggctaacacggtgaaaccccgtctctactaaaaatacaaaaaatcagccgggtgtggtggcacgtgcctgtagtcccagctactcaggaggctgaggcaggagaactgcttgaaaccgggaggcggagcttgcagtgagccgagatcgcaccactgcactccaacctgggcgacagagcgagactctgtctcaaaaaaaaaaaagaaaagaaaagaaaagaaaagaaaaagacgtgggatagacaagggctgggaaagagggttaaccaaagggttattgtagaaaggcaggagaaatggaaaaggtgagttagaagagacacgtagagaaggggctagttgtatgtgtttattgagtaaatgtggagaaaagaaaggtattgcaaataacactaagatgtctaggctgggtgactaagaaaaggaagtctcttttacttggatagtagtcagaagacctgggttcggggatggaggatgattaattccattctatgtattctatttttaaactgatagagatacattcacagggtggcttggagctcacgatagttactagctggagctgtggctgtagaaagcctcttaattgaagtgataggaagaagtggaaggttattagacaactaaggcagtgtggcaagaaggtggtcaatactcgaaggggatggctgagtccaaactctccctttcatagcctttttacccacagaagttctcaacttcatttattcatatcaaagagtgactgatgatatcttaaaatgtcatgtcttatggagatttacattttactggggatcaaagccctgaaataaagaaattaagccccagacaagaaatccagaagtcgtgggaaaggtgaccatgtgaccaccactaacacgcaaaggcctctaatatgcaatggccactggaccagccacccccttgacaatctaaaggagaatgcagtgaatacgaaggaggttttcccaaagtacaaaatacaagtatgcacgtacagtcaatcctcattattcacagattccatattgtaagttcacctactcactataattatttgtggcatcaaaatttacacttatagcacattcctgatcattcttggatgtgcacagggttgtgaaaaatttgagttgctcaacaagcactttcccagctgaggtcaaacaaggcaatactctgcattcttgtttcagctcataatgtaaacagtgtctttctcttgctctatttagtgcaatgctttttgcatttttgtgctttttgttgattttgctgtttaagatggccccctagcatactgctgaagtactctctagtgttcctaagtgcaagaaggctgtgatgtgtcatatagagaaaattcatgtgttagataagctttattcaggtatcgttacagtgctgttggctgtgatttatatgttaataattcaataatatatattaaataaggtgtgtttaaagagaaagagaaaacaaggttatatactgataagttgacaaaaatgttgggatcagaggcttgcaggaacctagccttgtatttcccctaggatcaatggtttacaattcactaattcagtatttgcagtgactttatttaacttagctattgtgaataacaagaatcaattgaatttctatttgtcttataggagagaggcattgtggttttccctcagctttacagatgtgtaactgacaaataaaaattgtatatttttaaagcatacaacatgatgttttgatatatgtatacattgtgaaatgattactgcaattcagttaattaacatatctatcaacttagttatcattttgtgtgtatgtaataagaaaatgcaagatctattgtctttgcaaatctcaagtatataaaacagtattattaaccatagtcaccatattgtacaatagatctccagagcttgctgatatcgtctaattgaaactttgtaccctgtaactaatatcttcttaccccaacatccatccctggaaaacattgttctactttctgcttctattaatttaactttcttagattccacatatgagatcatgcagtatctgtctttctgtgtctggcttatttgtcttagcataatttcctccaggttgcaaatgacaggatttccttcttctttaaggctgaatagtattccattgtgtgtatgtgtgtgtgtatatataatatattatatatgtatatatataaaatatatatgtatatgtatgtatgcaccatatttaaaaaattcattcatctattaatggacacctctgcttatgtgctggccctgctggaggggttcgttctgtctgatctagggactcagccactcacttccaataacagtgcttggtcctttcaacatacatcaattcaaaaaatgagtcaccatgctttactattaataataaggttactctcattacaaaaggtttcccagtggaaaagtatctaacaagggcagagcatttgaaacaagtgatgcaatctgacagaagtgggtaaatgcaactgtcaagcgtagctagctccagagccacaatggcaaacattttttatgtgattagagaaggtttatagtcaatgtagatggtagttttctttctttatatgcctgtctgttttcttgcctgactgcctgcttgttcctttcattcttataagaggtgagatcagaccaactgtttgattgtattggaggtttgtaagaaaatatagaaaaaatagggcaactttaatatggtttgaaatgtgctacagtaaggtgggaactcttaaatacattagaaggccttcctaaaagctaaccattttaggtacgagaatctccctacccccctcctccccaattataactaagagaatattctgctgagctgacaaagactagcaaaatgtttctaaatctatacatctgggaactctcataactctttttctagggaaaaaattttgcttctcttctttctgaaggtcaaccctgattgtataggagaaattgcttgcagctatcctgctatgcccagaagcacccttcagaaagaaattaaatgcattcagaagatcagctatcctctcaaatgatgtgaatagggacatgaggaacactgaaaaagggctttcgaataacttattactccctgattacaaggcacacccctggctgcttgatggagtgaggcaacagagttgtgatctcaaggaaaaactaggcttctctaactctgtgtagtcattgttgtctgtccatcctggacttgacagaggctgtctcagaatgagttttataggccaattcttaaaggtaattgaatatgggaagatggggtcttgttctatcatccaggcttgagtgcagtggaaccatcatagctcactgcaaccttgacctcccaggctcaagtgatcctcccacgtctcagcctcctgagtagctgggactacaggtgtgggccaccacacttggctaatttttgtatttttgtagagacaggggttttgccatgttgcccaggctggtctcaaactcctgggctcaagcaatctgcctgctttagcctccaaagtggtgggattacaggcgtagagtcactgtgcccagccaagatatattctctgttataccgcagatatttgggttgtttggtatttggctattatggctaaagtagttataactttattgtactgggctatttatacatatatgtttcattttctttgggtaaatacctaggaagagaattcctagactgaataaaatcttctttgggtataggccgggcgcggtggctcatgcctgtgattccagcactttgggaggccgagacaggtggatcacctgaggtcgggaattcaagaccagcctaaccaacatggagaaacctcatctctactaaaaatacaaaattagccgggcttggtggcgcatgtctgtaatcccagctacttggggggctgaggcaggagaatcacttgttcccgggaggtggaggttgcggtgagccgagatcgtgccattgcactcctgcctgggcaacaagagtgaaactccatctcaaaaaaaaaaaaaaaaaaaaaattctttgagtagatttctcaggaaatcactggaccctgtatcgctcaaaaagacttggttattctcttttcctcaaggtatggtttcttaactaaattgtcataagcctctttgggggaaggactgaaggaattgttattgaatctcctgctgtggtgttgcaggatcctttcttatgggaaactgacctattcattgacgcattctggttctgagaactggcgcaggtcaggaaatgggacaagagattttctctttttactgggcagctcaacagtcttctacccatctgttcttcatctattttagaggaaaatgaaatagacagagtgtgttattcagggttctccaaataaatggaatcaataggatatttatttattatgaggaattggtttacatgatcatgaaagctgagaaggctcatgatctaccatctgcaagcagggaagctggtgggacaattcagttcaagtctgaaggcctgagaaccagaagagtcaatagcgtaaatcccaatctgagggcaggagaagatgagaaaacatgctccagctcaagcagtgaggcaggaaacgaaagggacagattcctccttctgccttttgttctcttcaggccttcaacagattagatgatgcccacccatgctggggaggaccatatggactctacgctttattcagttcaccagttcaaatgctaacctcttccagaaacactcacagacccacccagatacccaaatgtgtatttgggtatcttgtggcccggtcaaattgtcaaataaaattaaacatcacaagtccactccctgtcgacctggtacccatagacatctccctaaattatacctaatctccaaataaagacattaagaagatcataattctgcctaacatgacacaactatcctgatacaaccaaaaatgcactaacccctttgccagaagagcagataaaatctttgagtgatatttactcttcttgatctgcaacttaaatattatgatataaaattaccaatatttaaatgccatgatataaagtccgtacatcttatgatgataggagaataagagaggaaagaaaaaaaaaagatacatacatatacacaaacacaaatatattcataacaaaataaggaggaaatacttatgataattacagtcctagtttctgtaactggtcatatggttgtagctggtatttatagctaccttcctccattacccattctgtgttccctttgctttcagcgagtacctcagctgattgtggttctttttttaattttttttgagacacagtctcactctgtcacccaggctggagtgcaatggcgcgatctcagctgactgcaacttctgcctcccgggttcaagccattctccctgcctcagcctcctgagtagctggaattacaggcaccaccacacccagctaatttttgtatttttaatagagacagagttttgccatgttggccagactggtctcaaactcctgacctcaggtgatctgcccgcctcggccttccaaagtgctggattacaggcgtgcgccactgcatccagccaattgtggtttacccggcggggtgacccaaacctccattcttaaaaggtctggcccattagtagtctttcctggattgagtttttgcagtttttaattaatgttaatcacaggacatggaaatactaaaagatgccttaagttatctcctatatttcagacataatctccttacctctattgcggagtagtactccaaaatccttcttggtagtcaggattaatcaccccagccaacactgtaactccttaacctattgattcagaggcacaaggagcccaacatgtggggctggcagccttaactttcagttcaatgaaatcattgctgtcttttctgttgggaacattcttccctctggaactaggtcatcagaacataaagtcacctctaggtcatcagaacataaagtagtgagaacaggaagcagaaattctggccgtgtgtcataaggggtaacagtgagtggtattattcccatttccagcccttgattcctggacctatgaattctggctagaggagaaacaataccatatagtggatgctgattcagagcaacatagtcttctggagaaccttgatccagccctacaaagtattgctacctggctgtcactgtaactgagtcttaaaaagaccattccaccgttccctcaaaccagttgcttctagattgtggggaatatgataagaccactgaattccataagcatagacccattgctgtacttcttttgctgtgaagtgtgctctttgattaaaagcaattctgtgtggaataccatgatagtagataaggcattctgtaaatccatgaatggttattttggcagaagcattgcattcagagaaggcaaattcatattcaaagtaaatgtctaatccaagtccaaaacactgttacttccatgagggaagcaatccaatgtaatcaacctgccatcaggtagctggctaatctccctagggaatggtgccatattggagaatcagtgttggtcttgctgctggtagattggacagtccgtggtggctgtagaaggatggctttgattagtgaaaatccatgttgctgaggccatatgtaacctctattcctgccaccatgcccactttatttatagatgctttgggtgatgacaggggtaactagggaaagaggctgactgatgtccataaaaatgggtcattccattcatttgattattaacatccccctctgctgagttcactgttttagccagggtttccaaagagacagaactgattttatatataaaatcagtccaaaacccataatatatatatatatatatatatatatatatatatatatatatatagagagagagagagagagagagagagagagagagagagagagagacaaagagagagagaagaatgaatttattcaggtaattggctcacttgattatggaggctgagaagttccacaataagctgtctgcaagatggagaactagggaaggcagtagcatggttcaatccaagtcaaagtcctcagaaccaagaaagccaatggtgtaactctcagtccaaggctgaaggcctgagagcctaggagtcaaggtgtgaatccaggagtccaaaagtcagagaatctggagtccaaaacccagagaatctggacatccaagggcaggaaaagaagggcatacaggctccagaagagaatgcaagaattcattcttctgccagctttttattccatctggacccttagctgactggatggtttctacccacattaagagtagatctttcccactcagtccaccaacttgtatgctagtctcctgtagaaacactctcacagacatagctggggtagcctggtctttctaatcaaatgccaaaccacctgggtttccctttcagcacaagaagctcagtgcccatataagcattgagaataattaatgcaatgattgagaataaatagtgcattaccagctatctgagtttttctgggtatcccataattcagttatgttgacactcaaaattaaccatcatcatcctttgttgagcattcacatggagcacttttttttttttttttttttgctgattaagggaagtctataaacatacgtcttccccaaatttcttcattgccaatttttcaatcatgttccttccaagtccctgatcatccagacaaacaattggccacagcccatgaattggtacataatggcacatttcttcttcttccaagcaaagtaaacaaccagatgcagagtctgaagttccacccactgtatttctcttccagggattgattttcctgtctttggagatgtcccagagaaaggaggtagtgccacagctgttaattttgggcggtgcctgcatattgtgcagaaccttctgtaaaccaggcctgagtcttttctttctctgtcaactgattctaggcaactccccagatggccttaggtacaggctgagagacagagaaggcagtagtggaaaccatgggaatttgggtcactttttcacgtgattcatttgtaccctcagagcctccttgcgatcactcacatatgtaccacttccctttggtgaattgccaacatttttagcaccaaggactggttgtgcggaagacagtttttccatggataggtggtggaggtggtttcaggatgaaactgttccacctcagatcatcaggcattagcttctcatcaggagtgcattaccgagatcccttgagtgtgcagttaacaatagggttcatgcttctgtgagaatctaatgccatccctgatctgatagaaggcggagctcaggcaataatgcttggttgcccgctgctcacttcccgctgtgcggcccagttcctaacgggttcggatatatggatatagtctgagccatgatatcaattggtttcctaggatttattgtatgggcccaccccatatttacagtaggaatagacgtagatacacgagcctacttcacctccgctactataattatcgccattcccactggcgtcaaagtatttagttggctcgctacgctccacggaagtaacaccaatgatctgctgcagtactctgagccctagggtttagaagtgttgttatgcatgcttagctttatagcatgttgggtcagacatgataaagggcagctcgggttgcattgtaatttggttgctcacagttaagcatttagtctctattaagacccagtagcaggccaagagctgcttctcaaaaggagagtagttatctgcagaggatggcagggccttgctgcaatatcttaagggcctgtgttgcaattcacttagggggaccttccaaaggctgcaaacagcatccctaacttctactgacccttcaagcaccattggagctgctagatcatatggcctaagtggcagggcagcttgcacagcagcctggacctgctgcagagccttcttttgttttgaaccccactaaaactagcagcttttaaggccactaagtaaatgggccagagtaacacactcaaataagaaatacattgcctccaaaatcccggtgggtgttgtgcttctttcttggttgtaggaagggccaaatgcaacaactagttcttcacctttcatgggagatttcaacatgccccatactactggacaccaggaatttcactgaggtagaggacccctgaaatttcgctgaatttatttcctatcctctgacatgcaaatatcttaccaaagagtcagaagtaattgcgactcgctcactaggtacagtcagtatgatgtcatcagtttgatatcttgtggaagggaaaatcaatcaagatctgttaattaaattatgacataggactggagggttgataaccttcttaggtaggacagtgaaggtgtattgctggtctttccagctgaaagcaaactgcctctggtggacaggtatagagaataatgcacttactagattaatagctgcataccaggtaccaggggatgtgttaatttgctcaagcaatgaaaccacatctgggacagcaagtgcaattgaagccacaacctggttaagcttacaatataattcactgtcattctccaagatccatctatcttctgcacacaccaaataggcaagttgaatggggatgtgataggaatcaccatgcctgtgtctttcaagtccttgatgatggcgctaatttctgcaatccccccagaaatgtattgcttttggtttactattttcctaggtagaggcatttttaatggcttccactataggctttcccaccgtaatagactttccctaggtcagggaattgatgttgagtttctgtcagctgctaaatatgtccactccaattatgtattctggaactggggaaatactcacagaattggtttgggaaattggaagaaacatgattggaaaattgatgacaaagagattttgatttatagatagacagaaatcctcaccagctgcctatctatcttgtccctaggaacactgcattctatttgtcagctccatagatccttgtggatcagaccttcctgactgcccattatgtcctgccttatgtccttgctctgatggtcgtgtttccatttggcttctgctttcccagaccctatatctgttgttattaggaagcccagtgctgtaaagtccttagctataaagcagcggttgccaacatttttagcaccaaggactggttgtgcggaagacagtttttccatggatataggtggtgggggatggtttcaggatgaaactgttccacctcagatcatcaggcattagcttctcatcaggagtgcattaccaagatcccttgagtgtgcagttaacaacagggttcatgcttctatgagaatctaatgccatccctgatctgatagaaggcggagctcaggcaataatgcttggttgcccgttgctcacttctcactgtgcggcccagttcctaacgggttcgtggcccaggggttggatgtccctgctatacaggacagctactactgagcttctcagtgatgctggtggctctctcaccatcatttttcttgccttagacattagagcatcctccaggccctctgcttttttttttttttttttttggcgatgaagtcttactcttgttgcccaggctggagtgcaatggtgcaatctcggctcactgtaacctccacctcctgggttcaagcaattctcctgcctcggcctcccaagtagctgggattacaggcacctgccaccacacctggctaatttttgtatttttagtagagacaggatttcaccatgttggccaggctggtctcgaactcctcacctcaggtgatctgcccacctcagcctcccaaagtgctgggattacaggcgtgagccactgcaccaggccggccctctgtatttgtctgctagttctgccatgcaaaatactacagattgggtggctaaagcaacagaaatttattttctcacagttctggaggttggaaatccaataaacatgccaagaggttgggtttctagtgaggcttctccccctggcttgcaaattgctgcctccttgctgtgtcctcatatggtctttcttccgtgcatgcgtgcagagagagacagatctctggtgtctcttcctcttataagggcaccagttttattagattagggccccacattatgacctcatttgaccttaattccctccttaaatttcctatctccaaatacagtcacactgggggtcagggcttcaacaaatgagtctggggggcaggcacaattcagttcataacacttttccaggacacattgttagccagttggttttctagtcttatattgtagattctttccagctggctcagtttgctgtgctttttgattccttcttccatgccatacttcttttaaggtgggtcattccttttttattccaggggtcttcttagcagcagattaatataatctggctcctgtggcccctgcgatattaaatccagtgttacgggaaattttccacatactggcaagctattatgcagctttatattacactctactcccctggatatggcaccctcaagatcttctcccggaaacactcctgattcctgctggtaaatgtaatccaggtattgcagctccttcagcatgtaactcctctccttccttggcagactcagcattccctagtcaggtcacatttagcttagaacctagttattagtgagcatgcccggaggagaggtaagggcagatcctgaggaggaaaagcattatcttataagccatttgcataatattcaaacaaggaggagggatacttctgcaagcccagaatgttcaggtggatcgaggttctcaggggcgtctacctatatatctctatcctaagcctcagactaccacaccttccctatcagacctctgactttgacatagggcttccctacacagaattcagcttctcttagagttctgcttctcctaaaattctacttctcttacaataattgtgcatggcattcagctcactatgccctctgggaaaaggaaatgtccaggagtccccttggcactcacactttgccttgatttagctactcaatttcacagtacttaagagttaattcttcgtatctttcaagtgccagagacaaggcacaaactagtgcatccctttccccgatattccatcccttctctctgcaggtgaaagttttagcaattgttttatcacagcatgctaggagttaccaatacctaccaccaatgaggaagtcctcattgtcatctatatgatgagttaaccaattccaggatcccatcattagagtctggtcccagaatcacttttgggcattgccttaggtcaggttgccttgaagaagcctaagaagaggcaagtgatttactgagggagtgctcttaggtaaaacctgtaagagagtgaggaaagtaggttacagcagggaaagaatcctaaagcagtttcagctgaaatcctgccttggcctgatcccacagggagctctaggatgtgagtggcaccacagagttcgtttgagtcaagagggctgagcatttatatcagtttgcatactgcctcctgtggacaaagggaattctttttttttttttttttttttttaagacagagtctcgctctgtcgcccaggctggagtgcagtggtgcaatcttggctcactgcaacctctgccttccgggttcaagcaattctcctgcctcagcctcctgagtagctgggactacaggtgcccgccaccatgcccggttaattttttgtatttttagtagagacggggtttcaccgtgttagccaggatggtcttgatctcctgacctcgtgatccacccgccttggcctcccaaagtgctgggattacaggcgtgagccaccgcgtccagccgacaaagggaattcttacgaagccattagccaacattctcagcagttggggtaagaggcaactgggcagggcacctccagggcctactacaaggctttgtaacatctggtatatttctcccctatgttcactgtattacgtgttgagagcatagcatatttactttttctagttatattgttagcatttcctaatgtcatttttttctatatgtcatatttactggctatactaatatctttaatttatttagctattctcctgttgatagatggatcattttaaagtttgctattgtaaataatgctagaataattgtcattagtcttgatgtattattttcataaattgttagattcagtttgatcaaattttggtaattttgcatttatattcatgagagagattggcctgtagttttcttttaatgtaatggctttgcctggttttggtatcagggtaaagctggttacagaaaattagtttgggagttaaatttagtcaggttatttctttctcctttactaagctttggcaatttgtgtctttgaagaaatttctccatgtcttctaggttatgaaatttgttgtcagaaatttatttacaatattcctttattaccttttaatgaccataagatctagagtgatgacccctcttttattcctgatattgttatttaatttcttctctcttcttgatcagtctggctaggagttcataattgtatttatcttttcaaagaaaaagatggacacttagactatggacttaagacttttattttcttctaatataagtaattaatgctataaatttctctctaagcactattgctgcatcccacagattttgatgtgtcgtatttttaattttatcctatgaaaatattttctaatttctttttgttatttcttatttgagctatgggttatttagaagtgtgttatttattttcatgtatttaaggattttccagatggcttgctatttgatttctagaataattccactgtggtcagaaaacatactctgtattatttgaattcttttttatttatttagcccattgagacttccacttttttttttttttttttttttggcccagaatatgagctataattgtgacgggttctgctgttgttgggtataagcattctgtaaacatcaactaggtcatgtttgttgatagtgttgttcaagtcatttatgtgcttgctgatttttgccaacttgttctatcaattcccaatagaagagtattaaaatatccaaatataattgtgagtttgtctattttttaaattttatcagtttttgcttcatgtattttggaactttgttactggatgaatacatgttaaggattattgtgatgtcttaattaattgacttctttataattatgtaatgttccttttcatctccagtaatagtccttgttctaaagctgactttgcttgatattaatatagtcactatagttttctttttgttaatgtttacatagtcattttttatcatccatttctttcaatctagctgtgttgttttacttaaagtgggttctttacagataatatataatttgtcttgtcttttaatccacactgataatttcccttttaattggagtgtttagacgatttatgtttgatgtaataattgatatggttttaaaatgtcatgctgctgtttgttttctatttgtcttatctgttctttgtttctttcttcctcttttacccccttttctaactttatttttttatgatctcattttatctccaccattggtttattagctgtgcttctttagttttgttgttgttattgcttatttttagtgactgctctagaatttttttttagacagagtattgttcttgttgcccaggctggagtgcagtcgtgtgatctcagctcactgcaacctccgcctcccaggttcaagcaattctcctgccttagtctcctgagtagctgggattacaggcacctgccaccacgcccagctaatttttgtacttttagtagagacggggtttcgccatgttggccaggctcgtctcaaactcctgacctcagatgatccatctgccttggcctcccagattgctgggattacaggcatgagccactgtgctggcttctagaatttatctttagcttatcatagtctaccttcaactctgcatatggtatgagattctttcatttatctcctctttagtccttggtagtattattgtcattggctttatcgctgcatgtgctaaaactcctacaattaaagaatgagaaaaaaaggtttttatgtatatcctcatattttccatttcctgttttttactcctttgttagatccaaattctccactgacatcagtttccttctgcctgaagaatttcctttagcatgtcttgcagtggaggtctactgacttttgtttgtatgaaaaagtctttattttgtctttgttgtgaaagatatttttggtgggaatataattctacattgaccgttgttttttctttcagtcctttaagatgtcacttcattgtctcctggcttgcatagtttcttacaagaaatacgctctaatgctaccttgtttcttgacacgtaaaggggtttcttttctctggctgctttttattactgtttttcaccaagttaactataatgtgcttttatgtatttttctttatgtttattccatttgagttttgttgagattctaaggtctatacatttaccacttttcataaattttggaaatttcaactattatttattagttcttcaaatatttgttttccttctctcctctactcttagaactgcatttactatattttagacaacttgatatttccccaaatgtcatggagccctcactcccttccttcctaccttcctcccttcctccttcccttccttccttccttccttccttccctctttctctctttctttttctttctttcttcagagtctcattctgttgcccaggctggactggtgtggtcataggtcactgcagcctgtaactttcggactcaagcaatcctcccactttagcctccccagtagctgggattataggtgcatgccaccatgcccagctaattttttcattttttgtagatatagagtcttactatgttcccaggctggtctcaagctactggactgaagcaatcctcctgccttggcctcccaaagcactgacattacaggcatgagttacagagcccagcctattaattttttaaaaatatttttttctccctgtgcttcattttgggtaatttttgttgttgggtctttatgttcactaattttttattttatagtattagtctgctgttacttttattcagtgtattttttatttagaatatattttcatatctagatgttccacttgagtctgttaaaaaatatcttccatttctcttgttgttatattcatgttttgctttacattttcaagcacatggcacatacctctaataactggttcaggtcttttctaattccataatctctgtcatctctaattttgttcatattgattgattattagcctgactatgggtcatatttttctcttcttcttgcctggtaactttttactaggtgacagccattgtagatataattttgtttgttttttgttgttgttgtttatgggtgccagattttgttgaattcttttaataagtgtggaccttgttctgataggcagttaagttacttggaaacagtttaattctttcaagccttgtttttaagcttttgttaggctgggtccagagctttgttaggctgggtcctggctttgttttagggttaatttagctcaactagaaaatgcactttgagggctcagcccaattccctgtgtattatgaggcctctttactctgactgatggaaaagcgaacatttcccagccgtgtgtaaactccaagaattactgagcttacttctttctggcttttctttttccagcgtcatagttttaccccacacatgcacaggtcagcagcagtcaaagattcgaaggggcccttctgcagagctccacagtgctctgtctgtgtgtctccctcatttctggtcctttgccctggcctccctgaaacctgatctccacctccttactcaatgagactgctatacctgtttgggtttcctttttcctgccctgcagcctggaaactgcctccaggaagtaactggggtagtcataaggagggctcacatcatatgcttcccctctcccagagattacagtcctgctttgctttctgtccaaagactgcaaacagttgtttcatgtattttgtccattattctaatggaatatgtcaaggaggtaattctgtcacagctattccttcatgggcagaacagaaatctatttcacatttttcaggcattttctaccacttgtcttcttttagtgtcctcagcataactttcaaaataattatatgagatacgtgtgtgtatgtgtgtgtatatgtgcatctgtatatatgagtatgtgtgtaattatcctcactgtccaaaatcgttggttctctgagttcagatagggagattcttgacaagagagtttggatagcaagggatgccttgttatctgaatcaatttggttctcgacgtttagctagtgagtagcagagttggaagggggagcagagaggattctcaatcagggtcccagtcagaaagtaatggttaattcaacgggtttaatgaaaaaggggtaaaagagaatgttagctagagagtggtgggcaagattaagggaaccaacaggaacccaaatactagcaccaatgggaagcagttaacatccctagtcctaaagggacaaagagaaggaatgtttttcccaaggccacccaataggatctgcggctgtagaggggctcggcccctgctgaggttgtggccaggctctaaggaaatggatatcggagaggccttcgttgtggttccctagaagcagactctgaagcaaggatttgcgtgtaagtgaatgattgaggaagtgctctctggagacacacatgagagaaacagggaaccaagacagggaaagagggaaagccttgcaaattacagattcaagcaatgtcccagcaccagcccaaccccagaggttgctctggcgtgaaatcatatatcagagtcatcacccttcagagtttttcccacctcaaggcaagggagctggttttcaacctcttacctcagtggttggctaatgtccagaggtgacataagcttccagacaccccccagctgtctacctgtactgggtgaagtggctctgtggcccaaagtgggcttctgaggaaagctgcaggtgtcagccaacagaaacaaaggacatagaaaccaggaaatggatgctcaaaaacaggcatgtgggtgtggcaccaacagtgtttatcacagtagaggagggaaatagataccccaaacacgctcaccattgatctcccattggccacgcccaattagaagctggagggcaaggcaacccaggggatgctatcctagttgtcagcctctggggcttagagtaggcactggagggtggaaaatggatctggatggagagcaaagggagaataaataggagaggacagcatagatctaaaattttatacatatctatttggtccttaaattcaaaaagtgatagtctggaaagcaagagatacttgtatgtgtgtaatgtatcacacacatacaagtctagtctaataaacgtaaactaatgtttattagactaataaccataatataatggcatggattataccctcaatgttacttctgtgactgtagagcaacctctctgggttaattccttatttataaaatttcaaaacacaacaacaaaaaaatgcatgtcttctatcttcagcagggaagagttatgaaaaataacatactaagtggttgagatgaaaagaactacttctcaatcttgcttgacccttggaaacatctcactatcttttgtgtgttcaaattccaggtactgacaatacagaaataaaaacatatcctggtagtgtctttaaggaaataggatactgaaaataaattgaacaaaatgtctttgacacttgtgatcttgagaaatcctgaatattatcattgtcttctgcttttttgaaaatttcacatttatttaatttctgcccctctgatatttgacattagcgctctggaaaaatatcaccgttggtgaaagccaagattccaaaggcccatgatgagagcaatagtttatactgggaggagatgggccaggaagatattaccatcatatctatggcactgcagccaaaggctgtgttctgaaaactctagacgacatcatttccaatagtgatataacttactcaagtcttctcttgaggcaaacaaacaaaaaacaaaaaaataaaaaacaaagatatacctcaaatctggatcctttataaatagatttccattatatgtgctcatatgacttacttaggcccaatgctatggacttatcagaatcccgcctgccccatgctctgtctctttctctctctctctctcaatctgtgtgtgtgtgtgtgtgtgtgtgtgtgtatgccagtaacaaaaacttaactcagattagtgtgggcataaatggggatttatttgctccgtaactctactggagaagtggcagcagagccagtagagtttgggagtggacctggctcttttccctctgactattccctctgctttcatttttatgttggtttcattctctctgacaggctttctccacttgcagggaagtgtagtctggctcccatctctccgctttaccaggggcctagggctcaccttctctggtgccatgttttaaaatcccagagaggggctcaattgtcctggcttgagtaaaaaaaatctatggccacagcgataggcaactctgattggggtctctaggtgaggtgctcattctttggccaatgaatggggtcgggcatgggaaagcaagaagacatcagttccctttgaaccttatagttagagtcagagggaagagcaaagaagaggctgttgttcaggtacacactgcaaagtggatgtgactacctttactttaaagatgagataaccaagtcccagagaggccaagggactcatttaaaactacagaggtaataagtggcaaagccatgattgatgagaggcgatatattatagagattaaaggctcacattctagaaccagatacacttgaaccgagatcccaactcttgccacttatcagtataatttgggataaattatttatctgcctctgatttctccccctaaatataggcatactgatagtatctctctcctaagagagttgtgaggattcaatgagataacgtacaggcacagtgtaattgctgcttaaatatttgctgtaattattggctaggatttaaactttttcaaagctgtacctgtgtgtttgtgagtgtcgggcccaatagctttgttctgttctcaggcccaatagctttggaaattttacacatggtccaaaaggaaatgaactgtagttatgaacccagtctccatcatcactgagcaatgagaccactaccagtcactgaaagggcttgagaaattgactggaaatccaaacccagtctcagaaatcaaggtctccagccaagtcttcttaccagaggggattctgtccatttacctgaagagctaatgtggcctcccaccttagagtgcttacgtcatccgtgcttccagactagactcagggaactgtggccagtcactcactcagtcaacatgcttattgagcacttattgtgtgtagaccctgagctctgcagatgtttgatatttatgcatcaagagtctctcctaggtggaaaatcagaagggcactgatttcttggatggaagaccagtaggagaggaaacctcctaaaaacacatattatctgacaaaattctccttgaaaccaaggtcgaggaaatttgaaaaaattttcaagggtaagaaattatgaatggaaattaagtatgtattatccatcgttactaactcatggtatataaaaacattaatgatactctcttaaaagcacaaaatgcactttttttgcataggacaaacttttcatgagcaaattacaaagagaacatttctggcaaaatagctgatgtacttactcatgaatgatgccttagcttgataacctgtgaagaatgcctattattcacggtttattgataggtattcattaattataatattttgtgaatccatggattcctttattcccagttttcacagtgttcacaactaataattaattcctccaacatcttaggggcaaatttaaagataactgcagtaaaacttgtactgatgttcagatcacggttttgttgcttgaagtcttggactaaggaacaactggttcccaagttatacccggggggaccccataaagggaacctcttcatatgctatcaaagaaagaaattcgcagtatgagagagtcataaatgatagtggtatttacagctggcatgacctgttaggtaaaccagaatctatgtagagttactgggaaaagttccctggatctcactaaagctcccaacatcagctttcataataggagggagatgctttctccagtcacccaacttctacccaaggtgcaggtagagagatggcatgatacggtggggagagccttggcgtaagagtccgggggccattattggttctgtcactacttggctgtgtgaccttcagtgagtcactttaccgcgcagagcctctatttcttcattcacaaaactagtttggattagttgtacgtcacaaatgggcaacctacatgaaaacattggccagtagttttgttttcattggcccacatggtgtttctaaaaatgcatattctttctggtttgctatagcccctactttttctaattatcgtatatccagtcttcttcacttgtttatgtcagttttctggcccctataaaccttgagttttggaatccctgggatatataatctctgatgttgctcccacctctgatacccagagactccaggtcttgggaggttaccaagctctaacagtcaggtaggagaaaaattacaacactgtgaagttttggagttcttttgttgttgttttttatttttttgtgtttttttctgagacccattctccctctgttgcccaggctagagtacagtggtgtgatcttggcttgctgcagcctccacctcctgggttcaagcaatccttccgcctcagcctcccaagtagctgggactacaggtgcccaccaccacacccagctaatttttgtatttttagtagagatggggtttgccatgttggccaggctggtctcgaactcctgacctcagatgatccacccaccttggccttccaaagtgctgggattacaggcatgagccaccacgcccacccagagttctttttttaatgctttccagactcccccatctggaagctgatgatgtaatctcctaggcctcttcctgtaaatcccctaaagccagggtctccattacagtcacagaatgagccttttctctcccttgttcatagtaaatgatatcacacagcttgtgtccttgactttttttctaattctgtctccttgatcttaaaggccagctaaggctatcacctacagggcaaagaagctcttattaagagcaaggcttgatcagtgatgtggcaaagacagctgaaaaagaaaaggtaaatgcagtgagagtcccccctcccacaccaaatttaagttagaaaggagtcttaaaggaaggctagttacttctaggattatcttctgtagatttccaaacttcttgactctttacagcagctctagcctttcctagttgagttggtttcatttagctatctggtggggctccctttctgtaggggaatttgttcatgttgacctaagggcacacagctgccgtcagcctctggggcacaggatctccgtaccaaagcaaccctgtactgtaggaagttctccacacatgtctgcacacaggagttctgtcattaacatggtcccggtcacccggtggaatgcacagagggtggggaaagtggcttctttctcaaaagccttctttttataaggcttggatccctgacaactggaattttcttttatagctgaaaaaacatatttcccttaaacaccacccaggcagtcgtatgtccttaaggtcaaagagatgagacaagaattgaagaggacccaactacagatcaatttgcctaaatgtagagtttgtctgcctatgaaatgaagaagttgcttccataagccacataattattgtggtttagtaattaactctcctttcttaaatagttaatttcccccaataataaaaatcagtcatacccactatagaaaataaagggagtaaataacaatcacccatacttttaccacccccaaattttatttaagcacaacctggagtctggagagttttttctatgcataagtatatttttaaaaatgtacttgagatcatactagtctcatctcttaaagtcacactttccttttcaggacattatgaaatctctccgagagaagttaaaagctaaattttttcacttaatttatttgtaataaaattttcaatgatttaggagagatgggaacatctgtccaggactatagagttttagccattgacagaagataggtattccatacttcctttaagatgccatgagttgtagctttattgggcttacatcacacaaacaaaacctgaaattcttgcccatgtacattttacgtatgacttctagccatctgttcagattcaccattaataaaaatatttaggaaaataattctatttcttattcctattgttattgtctcctagcaaacctctgagatttgacttagaaccactagtttttaagcagccttgggagaagtccccatgtatccaaggattttgccttgagactagaaataaaagtgattcttatggagagtggggtacacacaagggaatgaaaacctaatatgtgtttttggtgttaaaaataaatgaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgccctccagcctgagtgacagagcgagactccgtctcaaaaaaataaataaataaataaaaaataaatgaaaaagaagctcatgttcagcctcaagctttaagcagattggctagcaccatctagaaaatatgagctctagcaagagagctagaacccccttttccgtgttatactaatcttcaaggtgaagagcctctaagatgaacactagtcgaggaattctacaatgatggagggacagctatactaggagtactgatttttgctctgttccagccaggccaatcttcagatttagggcatagagatccctgatactgtcacacaaggcagttctcaaggttgcaaatgtgttcagggctcttcgtccccaatcggaacatgcatcagaaccacacagatgactgtccttctgtggagtagttacagagatgaacgtcattgaccccctcagtgatttagagcaaacaaggaggcagagaaaatgaaatgcaaagctgctttatcaggaaaggagtactatatgcaattatgtgaactttccctagcggcccagataaatgacagttttcaaaattcttagcacctaatttactcaggccttgaaaaacaagaactttgtctgaagctgggcatttactaggtggacatcatgccccagggagcatgaatgtttaagaggtttgctgaaatatggataacagttattttgattaacttggtccaattggcactgaggtcaaaattttgttaaccagagttcaactatttatacttctctattaacttaaaccctagtctcatgctgattttaggtgaaggagcacatgattagaaaatgtaagcaacttgagtacagaaattgagtactttctttccttctcttatcttctttgtaagcaacaataaacacttgctaatttaaaatgacagcttggattagtcacctgtttcccatttcaaaaaggacttcagaaccttttaacctacatggtggccatgaaaatgcagatcttggagtgtgggagcttaacagacctccagcctcagctgctgtgctctaaaatccatctgtttatatgaagcaggtgccccacagcctgctctgaaccaacaactgagttaggcagaaatgctaaggtggacctgtttctgggagacttgaggactccccactggcctcgctgaaattttcttagaactgcaaagtgatgtaaggtgtttaaacccaactttccatcctttcttctttcctccatagcgctcggacgtgcatcttggcttgatgactttctggcctcttccaacttccttccctttccctcacaggtacttttctcaataaatctctacacgtccaccagtattagaagactgaatgaacacatgctatttgacagccatctaaagtagataagacagatcctcattatatgaagttggaaatgaattttgaagggaaatcaattgtccatatcacagagtttttcttttcagcttatcagcaggcttaagaagtcaccttcacacttaaaaataatctatttgaccctacagtctcagtccttacctcactggactcctcctgtgcatttggtgggttgactacacactgctttgcccttggcttctagaaaccacttcgttggaaactgtttcctagtccagcccttgcatgttgatatcgcccgggggatcattgtcttttcttttttccattcatctatgctcatgacttcaactgttgcttgtgtgctgcccacccccttatccacatcttctgttgggttgaaggaatgaatggtgaaaacaggactgaaatccaagtttggctaggagatccatcccctttccatgtggtcatttgattggttacagtgacccttatttgctacaggatgtccagataacatagaaggaaaagttccattcactgcactatacatcataaggcaggaagagaggctgatgtttaattagattcaccagatgatgagataaacgattttctaggaaattgtcaattaattcattcaaaaatatatattgaaagcttactttgtacatgccagagactgttctaggtgcagaaaattgtgtaatgggtaagacaggtaagatcctgctcccatggaacttctactccagtgagaaaaacaaacatatgcataagataatttcagaaagtgataagtgctatgaaaaaagtagaaaatatatatataatagagagtggtggaagttgggggatgactcattcaatcaggtgatcatgaaaggccttgctaaggagtgagatttgaactgggacctgaatgatgagaagttgaatatgcaagtaactgaggggagagtgttccaggtagaggggccagcaactgcaaaggccctgaggttgagacggcttgacattttagaataataggaagtagccaatatgactgaaacacaatggtagagagggagagtaatataagatacattggagaggtagaaataccatagctcttataggcctacataagagcttcagatctcattctcagctgttagaaggttctaaccatgggaggaattggatctgacttatatctgtctgtttgtttttttatcaccttggctgctatttggaacgtggaatgaagagttcaaataggagggtcagctaagaggctttgagaggctggtagtggcttggaccaggtaggaaccatgaagatagaaagaagaggctgaattaggattatatgtttgtactgagagtacttgagagtttatatgtggggagtaagaaaaagagaaaaaacacgtctgactcttgcatttttggtttgagcaactgggtggatggtgaaaccatttcctgaaattggggaaatggggaagaacagttttaagagtgaactcaagagtttcattttggacatgccaaatttgagatatattagatatcccatagcagatattgtgtatgattagaaggcatatataagattggggtttaggagaaaggtcagtgctgaagatacatacatgtcaatggttttaaaaccatgagaatggatgagatcaccttgagttaagaaggaaacccatggctgggcccagtggcttacgcctgtaatctcagcactttgggaggccaaggcaggcagatcacaaggtcaggagatcgagaccatcctggctaacacggtgaaaccccgtctccactaaaaatacaaaaaattagccgggcatggcagcacgcacctgtagtcccagatactcaggaggctgaggtgggagaatggcgtgaacccgggaggcagagcttgcagtgagccgagatcgcaccactgcactccagccagggcaacagagtgagactccatctcaaaaaaaaaaagaaggaaacccatgatttagagataaagtacagaaagaggaatcagaaggagacagaaggagggactactgaagttggagaagtatttggagtgctcacaaaatgccaagtgttctggaagtgcttcagaaagaaaataatggattaattgcgtccgatgtagcctgagaggctgagtaagctgaggccagaaaagggacattgggttttggcaacatagaggttggagtttgtgttagtcaaggttcttagtgtaagtaaaagtaaatgactccagctgatttaggtagaaaagaaatttactttaaaagtcttggctgtttacagaattgtgagaagagctgttacacctggctagcaggccacacagacaggaacaacaccacctctaatctcatggtgtaatgggtgtggtgaggatcctactggtgccattcaatggagtatctgctatcaatcaagagtagtggttctcgaccttgtggctgcccattggagttagcagaaggattataaaaatactaatgctcagtctccatctctagagattaaaccatctttataatacatccctttaaggttggtttagacctccttaaaagggagtttggatttagaatgggttgactttggtataaataagtggtatggcctgagatgccccaattctgaggaatgtcttctaccataaaaagttgatgtcccttggtgctgcagggaccacgctgattcctgttactcctacctatgctccctaattcacccagctgctggtcatccacagcccctaactcagtcattcagagtttcaccaaaccagaagtctctttcctcagagcaggtggggctgactttccattgctctaatgctaaaggaggtttggggtaataccctatctccatgactgggctatagattctagaattgttccatgtaaagaatgaggattggctgggcgtggtggctcatgcctgtaatcccagcactttgggaggccgatgcgggcggatcacttgaggtcaggagttcaagaccagtctggccaacatggtgaaaccccatctccactaaaaatacaaaaattagccaggcatggtggcgcatgcctgtaatcccagctactcgggaggctgaggcaggagaatcccttgaacctgggaagtggaggttgcagtgagcagagatcgcaccattgcactctgcagtccagcctgggtgactgagtgagactccgtctcaaaaaaaaaaaaaaaatgaggatctctgaaaatagtcctttgtcatctttttaagcccaaatagaggaaggtttccagtgagttgggccatgaagatggagcagagggtattgcactatctacctgacataactggcctttctaggagatgttgtttgctcctaaagagatagagaaggggaatgatcctttttggcccgttccctgacaaaaagcatacataacacaatccttacgggaaggaagggccaagggaaggcagggccgcctgtcagctccttagatggtcttcccattcctcagaatgagggccactactactcctaccccatagtttgagttgccaaatttgactaaggcagaaagcccatgtgcctgactcctgaggatcacctgctacccaactggctctttggggtcaactctggctgaaatgggatgaaatctgggccttgcctgcctcaggggtggggcctgtgctaagtcccaggagttcatgctcacctgccctgtattgctaagcacaaagcatcatgctgtatacctgcacccccagatgtactaatccttcttctttctggatgtacgaatccaaacttatttattgggatgctgatttatttagaaaattaaaaatatattttgctcatcttttctgattaccaaaacaaaatctgtccattgtagaaaatttggaaaataaagatatgtacctagaagaaaaatgaaaaaaaaaaaaaacacacttacttatgagagataaggattgttaatacttcatgttggtctttttggtccctttttacaaatatttatgtgcaagtatatgtagtgtattataatgttaattatttcataacctgtatcttaatatatagtgatcatctttccatattattaaatatttattcctcccaaacagtactttttggcacttacaggtggccgcctcacagtgacaccaacctcaacatgaacttcccatttataacctaatcttgagatgtagggaagatgatggagttttttgcaaaggaagggtgtccagacacttcaagacattcagagaaaagactttcacaatagacacaaaatgaaatacagacctaggaaatccatgtgctttttatgagaatcttcatgcagcagaaaaggaagcaaaaatgacagaggatcacccagagacttatcacttagagccagcacacatcatagacaagtcccagggctgaggtgacagcagaaagggctgcacactgccagaaaatcgtcctgcttagtgaggcagaagcagacgaggccacttcaggtcaagctgtagctggcacaactccgtggtgagggtgccattttcctatttcttcctccgcccgaatgagggtcagggggaaagggctgactgccctcttgaaaagtgagtgctcagaaagattacaaagtctttcatgagaaatgacaattgtgaagtgacagagaagatgcaaggtaagccccacagagctagaaatccatagcctgtgattggggagattgtatctttaacttttggatttctaaggacatttaaaacctgccagaatcatgactgctctggaggcacatctgtgtctccatagcaacaggcttcctgctgcaaggtaaacctgggattgccgctctggtttctgtttggtgctgaacacacatgcttgatgattgaggacctgaaaaatgctcgtctgtcatcctttttagcccatatggaggaagatcttcaatgaatggggatatcaaaacggagcagaagtatttcactacctatataggtgattttctctgagcagtctctttcccaactttggaatcaagccaggccaatgactgtaactggggacttccaaagttccagaaagcatttccttgagagttgtttctgccttattcttagcaagagaaactgctagggtttggctatccattacgctgttcaaggtgaaggttagcaacaaaatatgtaattttcttatccttttttgctactgaagccacagatactgtgggagcaactatgggcttctactgacaccgttatccctgataatattgtaatctgtgctttctaactggcctggttttgaaaggagataaaatgggcaataccttgttagaaaaataacaataatatcattaattttgataagaacttatagaaaaataaggggtggaaaatcagttttttaacatgaatccaacataactgagtccatactgtggattcaggtttttttaggttatccaattcattcattcattcattcattcattcattcattcactactatgcattaagctttgccactgtgcatgatactgtaggagatgcaaagatgaaaaaagacacagctccactccttaacacctagtagcaagggagacaaaccaagtttacaagcaaacatattatataatttaataagagccctaagagaagtaaagataaattatacataagtttaagaaaggggccaagcgcagtggctctggctgggcacggtgggtcatgcctgtaatcccagcactttagggggccaagaggggtggaccacttgaggtcaggagttcgagaccagcctgaccaacatggtgaaaccctgtctttactaaagcaatacaaaattagctgcgcatggtggcatacatctgtaatcccagctacttgggaggctgagacaggggaatcgcttgaacctagggaggcggaggttgcagtgagacaagatcacaccattgcactccagcctgggcaacaagagtgaaactctgtccaaaaaaaagaagaagaagaagagggggattctgtagtttgaatgttcaaggaagactcatggaggagtctttgagctggaccctaaatgatgtggtgggatgagtgagaggcaattccaggcccagagtgagaaagttcaaatctgtggcaaacagtaagcagttttgtagacttgagtatagggtgcaaacagggaagggtaagtataaaataagattaaaaatgaaagtgggatgtatagtttggaggatcttgaatatcaagctaagcagttggaatttttttccaacagttgcatggcaacatcagagcacagagctgatatggtatcaaagggtgacatggattggaagaaaatgagggatgagaggtggggaggctactggtgcaatgcaggtaggagttaacagggcctgaagtaggacaatgacagcccaactaggaggcagaggcagaattctcaaagcttagcaacaaactggatgggggggcatggagccaaggatttatgccaatgacattctctaggtcagtggctctcaagcattagcacatcagaatcacttggagggcttgttaaaatgcagattgtgggccccgctctcagaatctctgattcaggtctggggtggaactaagaaatcaaattccagcatgtttccaggagatgacaaggttgctggtctagggaccacactttcaggactgctgttccaggtgctctgtggctcacccttgtgactgaacaaaagcaaccgcaaagggacaaggaaggcagaagaggcaatatgcaaccaacacacgtggattggaggagacttttcttgtcctttaaatctataggatacacaatgcctggggcaaaagggctcaggtaaaaatgcttactgcatgcaaagacatttgtattaacagataagtcacagcacagaatgtctctcatttaggctccctcctccatttttttttttttttttgagacagagtctcaagaaacagtctcgctctgttgcccaaactggagtgcagtggctcaatctcagttcactgcaacctccatctcccaggttcaagcaattcttctgcctcagcctcccgagtagctgggactacaggcgggtgccaccatgcccagctaatttttgttttttagcagagatggggttttaccatattgggcaggctggtctcgaactcctgacctcgtgatctgcccaccttggcctcccaaagtgctgagatcacaggtgtgagccactgcgctcggctgccctcccccacttttttctttcttaaaaatatataagtccttgtcttatgggaaggttataatgtaatgttgaaatcaacagccctgggttcaaatcctgactgtgccccttgggccaatgacttaactttttgaagtctcagtgattctatattaaaattgagataacaatgcctagtgaacagtgttgtgaggaataaatgtggaaagcacttgggaccctgcctggcacattgtggggctcagtgaattttggtttcctccctactccaacccttccagtgggaatgaagaggatgcatccccagcggaaagctgtggaaacacgagttggtcaaacagcccctcagggacacccaaggccccacagtcaccctgtcatgtctttggattaagcatcacccttttatacctctctttacaaatgccatcatgttgaatctccaaagaacatgggaaaattagtttgtccggtattttctgcctgctgggaagggatgggacagggactcagagggcggaggcatgaaaacaaagcaaagttttgactccggtggaattttattgtgatcaggtgggcctgaccagagcagccatccttgcgggtcttgaggctttgatcttggagataaggcttttgtgaacctcagaggattttcagagtagctattgtgccccagtaaagaaatgagccggtaagcattttttctttaaccagataaatctggtatcataatatccccagacacgaaagcagaatgcagacttggcattgaatcacagagggaggaacgtctcagactgagcctgtgccatgggaacctgatggcaaacagggcctggagccccctgcccccaacattctggagaaagggtttgggaaaaggacagccccttcagttcaaccagatgcagcaaggaagtgggggtagattggaggagagtgggaacacacacaggtgattctcctgctctgggttgatcaaaccaaatatacaggttataggttagtgggaaggtgaagaccctattcacccatttaatagggaggtggagtgggagggaaaggtctttccttccatggtccccacccaaacaggccaacgtatggttctgtgataggtgctaacaagccaacattactgaagtatctgcttcatgtagagtccattgattactaatgaagagaagcatcaatagttcaggtccaccaggttgctggctgttaacccatattcttcgttttttaaaagtttatttaccaccccaatcttcccaccccaagttaaatccagtacagatacaaaggaatactgtgcaactaatataaatgcccttgcagaggactatttaatgacaaggaaaaaaatgtaggttacaaaagcagtatagccccatttttattttaatgaatgaaaaaaggcaaacatgtctcaggggtcaactctggtggtggaattacagataattttattttccttttcttatctgagtttttgaaattatttacaaataaacatatattacctgtaagtaaaaaagacaaaattatttaatttaaataaatatgttcactacaggtcatgatacccttttttactaaatatgagtatgagtaaatgtgagtacacactacatataattttgcaatctgcatgtaagcattgtccatgttattaataagatcataattattatttttaatggctgcatggtattttatcatataaaaaaccatgatttttttctcaatttccaattgttggctatttatattgtctccaattattattattataaataaggctgaaatcaatattgttttagcttatttaatttttccatagatttctttgaaaatgttagccacctacttattttaccttaccttcaactgccttggcaggattgaatttccatatactcacacacctgcataaacatctttttctttctaactgtataccaatgagcttttagtgcattttttttttaacagggtccctctctcacgctgatatttcttgtaggattgttagtcattcaaattgccaagacagttgtcaatcacaaattcgggctgtagagatcatctagtgctatgtccatttacagggagaaagccaaggcctggagaggtgaagcgactcgcccaaggggctatccagctacttagtgaccaagctggaatgacaatttggagaatattttccaaaggctgggaattttgagggagggtcactaaatgggaaacgatggtaatatttggagggaacattaaacaatgatagagcagaaggtagggagaatgaaaaataacttagcagtaagaaggggagggagtagaaagattgataggagagaggaggagaggctggatgagggaggagaggatgagaactgaaactaaggacaacaatgtaaagggaaaaagaaaaagtgattgaggaaaattcacacattgaaatcctttatggcagggtttctcaaccttggcactattggcattttaggccagacaattcttccttgtggggctgttctgtgtaatacaaaatgttgagtagcatccctggcttctacccactaaatgccagtagcatcctctttcttccgcaccgcccgctgtgatgaccaaaaatgtctccaaacattgccaaatgtcccctcaggggcgaagtcacccaaattgagaaccacagctctatgatattgttctccaatgatactactggagaatgatttctcccattccttaatactggaatggaatctagactatctcctgaaaggcagaattggaagcagaacatttgaatgcagtttatagattgtaggtctcaaaacagtgaggttgtgctgaaaggcagggagggaaaatgattaaataaagcccatttttcagataaagagaatgagacaggaaatacacaatttgcgtcaggcactaagatgagtcaaagagaaaccagtaagagacacatgaacttagtatttgactttttgaaagaagaaaaacaattttatcaccaaccctccccaacttcaatcctggatctttgtgagaacaaggaagggaattgttactctccctagaagctgacaaaacatcaggaattggaagttacatttagaaatgttgcttttcagtgaaggacaaaagtagaggatggcaggagctagagctgctgactgaaggaaaaaaatagccattgtgggcccaacattgagaccccgccttagctcctcaaatcctcccatcatctttgaggcaggccctattcttcttttcttcttttcttcttcttcttcttcttcttcttcttcttcttcttcttcttcttcttcttcttcttcttcttcttctttcttcttcttcttcttcttccttcttcttcttcttttcttcttcttcttctttcttcttcttttcttcttcttttcttcttctcttcttcttcttttcttctcttcttcttctttcttcttcttctcttcttcttcttctgctttcttcttcttcttcttcttccttcttcttccttcttcttccttcttcttccttcttcttcttcttcttcttcttcttcttcttcttcttcttcttcttcttcttcttcttcttttcttctccttctcctcgtcctccttctccttctccttcttcttattttttattttatttatttatttttttgatggagtcttgctctattgccaggctggagtgcagtggctcaatcttggctcactacaacctccgcctcccgggttcaagcaattctcatgcctcagccttctgagtagctgggattacaggcacgcgccactacgcccagctattttttttgtatttttagtagagatggggtttcaccgtgttggccaggatggtctctatctcctgacctcgtggtctgcccgcctaggcctcccaaagtgctgggatttttaattttaagttctgtgcagaacgtgcaggtttattacgtaggtgtacatggaggcaggccttattattaactacatttggcggatgagtagctgagggtcagaagttgagtgattcgcccaagctaagtgatgaggccacaatttcaaaccagacccacctgattctcgaggcagggcagtaacctctgagcacccctgcctctatgccacggacagagcctgcttctgtaagattaccgctctgtctcattttagggtacttcccaagaaactccctcagttcacctcatcatgggtacaggtgagaggactcgtcactcactgtgacagaggcatgcagcctggaggctccccctgggggtttgcccggatcctcacggtgcaagaacactgacaagatcctgccgtggagttggtcaagatttcctggagtgctaccagaggcctattctgggcttgcacacacccaggccctccctctgggcctctcctgcagcatggtggctgtctccccactggccctccagagccatagtggccctggtacaggtgagctgtctccccactccatcctccagagccacacagccctggtacaggtgggctgctgtgaccctgacatggtgctgtggtttctttccttcacaagcacaattaggcaagccatcgctgtcagattcattttatttttaaaaaacttgtttggtattgtatttggcattttaaaagatgttttatggtgttacattttaaaagccaatttgttttcaccgcaggaaggccctcaggagggaagagctgttttttaaactgttccccttgtacaaaaatattttccaagttatttagatttatagtacagataatacttgtctcccattggtccaggataacaagtaataataataataacaaatagtgtaatctgcttaatctgaactatgcgctctttttttttttttcttttgagacggagtctcgctctgtcactcaggctggagtacactggtgcgatctcagctcactgcaacctccacctcccaggttcaagcaattctcctgcctcagtctcctgaatagctgggattacacccacaccaccatgcctggctaatttttgtgtttttttagtagagacatggtttcaccatgttggtcaggctggtctcaaactcctgacctcgtgatccgcccacctcggcctcccaaagtgttcggattacaggtgtgagccactgcgccccgccatatgcactcttatatgtacatacactatgcacttttacacttttatacatgaagaagttgaggcatagagaagtgaagcaactagtcccaggtcacacaactgagacctgcaaaaccttaaaaaagaagagagtggaaatctttcaacctgattaaaaagtattcctgctttcaacataagctgcatataaccagttccaagattgcagattcacttcttcctacaaatatgtatcgaaaacctactatgactccattcacaggaagatggtgcctcagtcaagataagaattcccggtctatgatttcagcactggatacaggcaggcagtattattttaaaaagtttgcagtataaaaaaacttctctcctatttattgcctccacatggcaatgtccctcccatctctctttacaagagaaggcagccaggcacctttgtctgtttgtctcatcactcaacccccgacttcccctctcactccacacaactgcatccccaagtgctgccctcaaggctgggcctaatgggcacatggagtccttatcttactcatcttccctgtggcatttgacacgcttaccaacttcctattccttgaaattcccttttattgaaactctaacaacttcccaagacttcctgaggtcatctttttctcgttcccctcccactcctgggatgctccttcttgttctctttcgttataatgactttcaaaactgggaacttgaagtgtactttgtgcaaattaactcacatggttttgatgaactgaatcagcatcatacccagcgcagggatgggaaatagagaggaagacccactgcgggacttctgtttgcccactgattcagtgagaagccaggatgccaggtccagcacagcaatgagtttgattgtgttgattgtgtctcctccagacattcactgtcaactctcaatgcagaaacagctcatgaactatatttaggaaggacagagcctgatgagtgtggaaagactgcaggtttgggcacagggctggatttaaaggtctagacctgtgaacaccacctattttgttggctgttaattttaagtgtatgtttgttctaacaacaggaccctagcttctgctggcccttaagggttacaagattttcctcctggtgacagattgtttggctacatcccaaaagatataaaactccttccagtcatcccagaattaggtccatagatttccagttatagaagagagccattctgggtaacacagcagatgtaaattatgtgcctgaattgattttgcattaatttctcgtaggctattttcatgctgcttaaataccactttttaaagccactatggtattgtattttaaaagctgatttgtttccaccacagaaagggcttcaggaggcaagagctgtttttcaaacccttccccttgtgcaaaattactttcgccagtgaggaattttcagtaatgagctgtctgtttgcacaactcttcagtgcatgtttgcatgctgcttctgtaagcttccttttgcaagacatatcatgagacacaaacttcaagtttcctactcccttgagggaccagccctgccactcattagcttaatatggaagcccaggggctcagataataacactttatgttcttgctgtacagcagggccagtatgctttgtgctgtggactcttggctgtcctgcttgatccaaatgcttttggaaaccatcagataaagggcaaaaagacagtctgtaaatctatggggtttttggtacagaaatagggctaggctcacattgaactcctgaacatgatatcaaagctcttattacaactttttatgcatgaactttcatatatataaaactggacatcacatagcaaagtaatagcacatcagctgttcctaccactaacagatggcaggagcaggcaggggaacttcagctgaatttcttcactgatgtggccattgtttgctatgtttgggtgtttgtttgttttttgagacagggtctcactctgtcacccaggctggagtgcagtggcatgatctcggctcactccaacctccacctcccaggttcaagcaatttttctaccttagcctcttgagtagctgggactacaggtatgtgccaccacgcctggctgattttttgtatttttagtagagacagggttttgcgatgttgcccaggctgctctcaaactcctggcctcaagtgatccgcctgccttggcctcccaatatttggctttcctttgattttacaaatggcctgacaaatcaactccctcatccccacttaagtactaagagtattgaaaatgcaattaaaaagaagggtaaattttgatggaaactacagttttcataaaagtggaaagaaatggatgatgaatggctcaacaggacaaagaggaagctacacaaaattaaaaattaaaaaattatcagtatagctggaagactggaactgaagttggatgtctgttatcctgaggttaattcaggagaaggctctggactaaaagacaattggactgagaactccctttagggatgtcacctattaaagaaaggtaattttgtacaaagctgccgcatttaccgtgaggctgctcatttttagattctagcaccacctagaggacagaatgagataatttccattcaccactgaacctaaggaatctttcatcaattaaccgtttttcagttttcaaaacacttaaattttaatatctgatttgatatccaaataattgtctttgaggtaggaatttctacctttagtgtactgataaaaaatcaatttttccgctggcttactgtccaaagaatttgatcagttttttatgtgatcaaaaattattatccatggattattttttaaactttatttaggtacagtttatatactctaaaattaactaatttaaagtgtgcagttcaatagtttttggtgaatttactgagttgtgcaaccatccccatagtccagttttagaacatttttatccccccaacaagattctttttttttttttttttgagacagggtcttgctctgtcacccaggatggagtgaagtggcatgatctcggctcactgcaacctccacctcccgggttcaagcaattctcctgcctcagcctcttgagtagctagtattacagctagtagctggtattacaggcacctgccaccacgcctggctaatttttgtatttttcagtagagacagggtttcgccatgttggccaggctggtcttgaactcctgacctcaggcgatcctcttgtgttggctttccaaagtgctgggattacactcatgaaccactgtgccagccaagagtctctcttttttacagttaatccccattctcacccagccccatgaagtcaccagagttttttctgtctgcatagatgtgctttttcttggaatttcatataaatggaataataaaatgtgtggggtttttttgcatctggcttcttcacttagcataatatttttgaggtttatctgagttgcagcatttatcagtatttcattcgttttgattgctgagtagtactcccttgtattgatataccaattatatttgtccattcaccagttgatgaacatttaggttgtttccagttttttgctattttgaaaaatattgctatgaatatttgcatggaagttgtttttctaagtaagaaactttaattagtaaacagggaagtgaataaaacatgtggaagaagggtgattatatgaattatgtgtattgaggagaaaaaaatagaataaacaatcaggagatgcctaagggaaaggcatctgggtcctgggccccggattcaatgtgtacccaggaaccaaggagttcttggtatcgtattcttccagagacacagaagaagcatggggaaaattattcaggatttgctctgatagtttagcagtatttgatgacagtttttaaggtgtttcttaatgttggatcaatacaatatgtagccgatgcagaccttggtaacacatctgaggttggagattgaagtaccattatgatctctccccatcatgaagatagaggtgaaggggacatttcaaagtgaaaaataaactatgtggtcagatgcatttgagtccaaatccaggctctgttaatatctataaggactgcaaggtcaaagttctcatcagtatccctggaggccatggtacctatctcacaaggctgttgtgaggatttgctaagatgctttatggaaagcacttagcatatggcctggcacacagtgagttctgatgttatttttgtaagattggattgtgcttgacaaacccaggaacagtgacattgacttctgttattcctgagaaccttttacatcatttcattggatgtttctggcctgagattctggcaaaaagaagtataaattttcttcagagatgataaaaatgtttgtgtaagtggaacctcattaaaaaatattgcttgtcacccagaatgttgtaggctggtggaaagatttagtgctaatctcaagggagtggttaggacttagggggatccacactggaccaatcagcatgataggttactaactcattttgcatataaaaatgttgtctaggactctacagaattctccctattaatggatgacagtcagaggtccttgggtttaatcaaaatttaataccttgtgagaggaaatatgaagaatacaaatgatcagtaatagacaatatgtcaaatgcagtaattgccaattttaaaaagtctccttgtcagcatatctaccttgatttgtagttaggaacacatggccagagctgtattaagcctctgggaaaacaaaggaatgagatacatattctgttgcaagaaaatatatcagagattcaacaaagccatcatatctaaaataataaaacagcatgtttaaaaatatttaaatcagggaatttctccccccccccccccccataaaactgaaggctcctacttcatctggtgcagggcagatgaatcttccatgaactgcttttatattcacccaagcagtatattaagaaggctgaagtcagaatgagttccagaaatctttctgttgaggaaaaccagaatctgaggaaggagcagttattagatgtgcttgtttgtcaccagaagaatgcaaacaaagaaatacagatgagttcagagtgctacagatatcttagagcaaaccagataactattgacttggtgctatatactgtaagggaatagcaaccatgttagacattttggtatactgacttattggctccaatttttatagccttgtaggcacagccattaccatgtggcttttgaattcctccactagaggcattgatgttgggtttgaatattttgcttcctgtggccaataggatgcgagcagagtgaccatgtaccagttccaggcttaatccttaagaagcatttgtgttttcagttgctgtctttgtttctgccgttgttatgagaagaaaatactctggtcagcctggtggtctgaggaggaggaagagagacgccacatgaaacagttctggaatcacgctcagcctagatcagctgacctctagccaacccacagatacgcaagcaagaataagggattgctgttgaaagctgctggattttgaaattgtcaagcggcattactctgacaataggcggctgacatagatggctgttttatagggttagttgaaaaaaagactgggagaaccttaatctaaggactatcaggtcttcatggtcacattttttctgaacaattgatagaaagttaaattttctacagaaacaggagcatatactatatctaaaattgatagtcggattgtttgggagcactaacacaacaggttttccactgatttatatagggttgggaaagaaacgtgctctgatttttgttttagctaattaatgctacctcgtgccacccactctgaaaaagctcttcttctttttatacccatcctcctcaaatgtcagaagactgggagtgggactgcttgccaggtttttgttttcttatttgaagtcctctctttgtaaatctagctgggaatctccacactgttttccatagtggttgtactagtttacattcccaccaacagtgaaaagtattcccttttcaccacatccatgccaacatctattttattttttaatttttttattatagccattcttgcaggagtaaggtggtcttaccttgtggttttcatttgcatcttcctgatcacgagtgattctgagcattttttcctatgtttgtttgccatttgtatatcttcttttgagaattgtctattcatgttcttagcccacttttcgataggatggtttggttttttcttgctgatttgtttgagttccttgtggattctggatattagtcctttgtcggatgcatagtttgtgaagattttctcccattctgtgggttgtctgtttactctgatgattatttcttttgctgtgcagaagctttttagtttaatcaaatcccatctattcatcattgtttttgttgtatttgcttttaggttctttgtcatgaagtctttgcctaagccaatgtctaggagggtttttctgatgttatcttctagaatttttatggtttcaggtcttagacttaagtcgttgatccatcttgagttgacttttgtataaggtgagagatgaggatcctgtttcattctcctacatgtggcttgccaattatcccagcaccatttgttttgtgtcctttctccactttatgtctttgtttgctttatcgaatatcagttggctgtaagtatttggctttatttctgggttctctattcttttccattgttctatatgcctatttttatatcactaccatgctgttttggtgactatagcctttttgtttttgttcttgtttttgagaccgggtctcactctgtcacttaggatggagtgaagtggtacgatgttagctcactgcaatctccaccacccaggttcaagtgattttcatgccttggccaccggagtagctgggattaaaggcatgtgccactatgcctggctaatttttgtaatttttttagtagagacagggtttcaccatgttggtgaggctggtcttgaactcctggtctcaagcgatccacctgcctcagcctcccaaagttctgggattacaggcatgtgccactgtgcctggctgactatagccttataatatagtttgaagttgggtaatgtgattcttccagatttgttctttgtccttagtctccctttggctatgagggctcttttttggctctatatgaattttaggattcttttttctagatctttgaagaatgatggtggtattttgatggtaattgcattgaatttgtaaattgcttttggcagtatggtcattttcacaatattgattctacccaaccatgagcatgggacgtgtttccatttgtttgtgtcatttatgatttctttcagcagtgttttgtacttttccttgtagaggttgttcacctccttggtaggtatattcctaagtattccttaaagaactaaaagtagatttaccattccatccagcaatctcactactgggtatctacccagaggaaaaagtcattatataaaaaagatatttgcacacacgtttatagcagcacaattcacaattgcaaaaatatgaaaccagcccatgtgaaaatatggaaccagcccaaatgcccatcattcaacaagtggataaagaaaatgtgatatgtgtgtgtgtgtgtgtgtgtgtgtgtgtgtgtgtgtgtgtgtgtacacccacacatggaatactactcagccataaaaaggaatgaaaaaatggcattcacagcaacctggatggaattggagaccattattctaagtgaagtaactcaggactggaaaacccaacatcatatgttgtcactcataagtggaagtgaagctatgaggacacaaaggcataagaatgatacaatgtgctttggagactggaaagggttgggaggtgagatataaaagactacacattgagtacagtgtatactgctcagatgatgggtgcaccaaaatctagaaatcactactaaagaactattccatgtaatcaaacaccacctgttccccaaaaacctattgaaatgaaaaacaaaataaaatataaacaaataactggtttttttgctgcattaattttcatttgttagccttgtggaagaagtctggagtaccccctaagaattggcaaggccttctggcttacagcaagaggggagacagtgtgagaggtaaataggcagcccagcaatccctggtagagttgattggacacaggaattgggacaaagactaaagccaggtctgagttggaactctaccattcctagttgctttgtaaggccagcacttccaactgctatcccatatatctaattccatcatctaatgtaactaacagaccctgtaattttgattctgaaagtgttataagaatgttggaaagacaggaaaacataaagaagaaaaataaaagcagaaataagaccgccacctagagataagctctcctaacattttgctatctgatatggtttggctctgtgtccctacccaaatctcatgttgaattttaatttccaatgttggggtagggacttgctaggaggtgattagattatggaggcagatttctcccttgctgttctcatgatagtgagtgagttctcatgcgatctgatggtttaaaagtgtgtggcatttcccccttcactctgtctcttgctatgccatgcaaaaaaggtgcttgcttcccctttgcccttccaccacgattgtaagtttcctgaggcctccccaactatgcttcctgtacagcctatggaactgtgagttggttaaacctcttttcttcataaattacccagcctcaggtagttctttataacagtatgagaatggactaatacactatctatctttaattctaatctttttttttctccttgggaagtatatatttctcaaacaaagttgatttttaaataaaagttatgattccctaaggtgtattttaaaaggtggttaaaaggcattctgtgacaaaaagaattcagtggtccactaatttgaaaaacactatattttatgtccccctttcatggattaataatctcataattatattaaggttctggaaatatttatagtaaagaaatttttaaatcccaaattttattacctacaaaacactaattttttttatagaaacctactaaaatattgtgggactccatagactacctacttggaaacactggtttaagatgtttatctcttttaatttatcttgcctggtggttggtgagtccttttcatttatagactcagatctttctttggattgggaaagttttcttctgttatttctttggctgtggcttctgctctttttgtagaattaatataattatatgggatctcctgaaatttttgcatatctcagcttcattttcattgtcatctaataatttttctctttcaaaattttcaagattattttctacttgattaattttgttacctgcaatctttaatctgtagaaatacaattacacatattttcaagaaatgtctattttcaaaaaggcagatacaatttgggtggtttatttaagatgcaaatccattttcacttactttctgtcagagtttttatttagaaattaaggtctaaatgtttgcttacttttttaatagcttaaaacttgcatttaaagtttgatattttgtttggaactccccctcactgaattagaataagaagtaaaaaacctagtagcagggaaggaaatgaactctcctagatattggggtctgtgtgaagatgccacatcagaatgggaataaatgtggctaccagaggagcctgcaaagtttctggattctaatggaaaagaagaaactgccttttgcctggaatttcctgatgtggccccaaatagctatccatctcatgcccttagacatgcttttccatacctgtaagttaaatataagaaaattgcagtgtcaagtcgacataggcataattatgtataagcatgtatacaatacacagagagtttataccacacacaatgttccttctcgaaagatacagtaagaatctttagtcggtgtgacttacagaagcattcctgtagagggttcattttattccctgctaaagaacattgcttagctctactgattcatttctgagagtcttgtggtgtccttgacccagcctgatctgcctgggacgtggcatctttttatcagcgcctttattattcatagattttgtatctctggatacttcaagtttacttgaagtactgttttttaaatttgatttctaagatagctttgttttctccaatctattctgcaaaagttcctgctgttacgccacttgttactccagaagtgcattttctctcctatgagtgctctttgcatatcttttttctttctgtcatgactccatttttgctggctctgttcttttgcacggacaggctaattctggtaaggctccaatcaggattttgacataaggagttatttcttaatatacactaggctgaaaaaaatgatttctcaaaagtgaaacaatcccagccagagctcacatcataccagtgtcacataggcttcatgggaattcaaagtttctggccataggagaatgaaggcaattttgatgacagtagcagacatagctcagggtttactactgtcttgaacctcaacaccaaaatattcttttctgagaatttagatgaatggcacttattttcaaaatgtttgctttcttcttcaaagaaacacgatatttcagagtaaagtttaaagtgaaacactttctaggaacaaaatagctcgctggtgcttaactgttataacctcctataagctaaatatttgcctttgtatagttctaattatctttgtctctcttccagtccctggatacccagatgcccttcatagctttaggctcaggtgcttcattctactctttgatcacttttaagatagggttactagataaaatacagaatgcccagttcaatttgaattttatagaaacaatgaataatttttttagtgtaagtacgtcttatactttaggataagtatgcatgaggaatactttttactaaaacaagatccattatgaaatttgacaaaagaagcacaaaacttaaattatgaaaactacccaacattgctgaaagaaatttaagatctaaataaatagaaagacatcccttggtcatagatgagaagattaaatattgttaagacagctatactctccaaactgatctatagattcaatgcaatctgtattagaacaccagctggttctttgcagaaattgacaagctgttctaaaaattcatatggaaactcaaagaactcagaatagcccaaacttttttgttcttggaaaaaaagaacaaactggaggactcacttcccacttttgaaacttaatacaaagcaacagtaatcaagacaatatgatattggtataaggatagacatagattaatggaaaataattaaaagttcggaaataaactcatgtatctatggcaattgattttcaacaagactgcaaaaacaattcaatgggagaaagtatcgtattttcaacaaatgatgctgagacaataggatcgccatatgctgaggaataaagttggactcttaactcacactgtatataaaaattaactcaaaatggatcaaagacttaagtgtaggagccaaaattataaaactcttagaaaaaatattgagataaactattgtgacctttgatttgccaatggattctcagatatgacaccaaaagcacaatgaacaacaacaaaaagataaattgaacttcattaaaactaaaaaattttgtcctacaaaggacactatgaagaaagtgaaaaggcaacccacagaataagggaaaatatttgcaaattatgtatctgacaagggacacatatctagaatatataaagaactcttgcaactcaaaaataaaaagacaaaccaattaaaaaattaccaaatgtctgaaaagacatttctccaaagaagataaacaaatgaccgataaacgtattaaaagatgctcaacatcattagtcatcaggaaaatgcaaatgagggtgactctctttttggacttagcccgcctgcacccaggtgaaataaacagccatgttgctcacacaaagcctgtttggtggtctcttcacaccgacgcatatgaaatttggtgctgtgactcagatcgggggacctcccttgggagatcaatcccctgtcctcctgttctttgctccgtgagaaagatccacctacgacctcaggtcctcagacccaccagcccaaggaacatctcaccaattttaaatcaggtaagcggcctcttcttactttcttctccaacctctctcactgtccctcaaccactttctcctttccactcttcaatctctcccttctcttaatttcaattcctttcattttctgggagagacaaaggagacacgttttatccgtggacccaaaactccggcgccagtcacagactgggaaggcagccttcccttggtgtttaatcattgcagggacacctctctgattatacacccacgtttcaagggtgtcagaccacgcagggacgcctgccttgttccttcacccttagcggcaagtcccgcttttctggggaaggggcaagtacctcaaccccttctctccttgtctctaccccttttctgctttcctggggcaggggcaagtacccctcaaccccttctccttcacccttagcggcaagtcccgctttcctggggaaggggcaagtacccctcaaccccttctctttcacccttagtggcaagtcctgcttttctagggggcaagaatccccaatcgcttatttctgcaccccaacctcgtatctctgtgccccgaccccttatttctgtgccccaaccccttatttctgagtcccatcccttatttccgtgccccgacctcttatctctgcgccccaaccccttttcccacttttctggaaggtaagaacccccgaaccccttccctccatttctctactctctcttttctctaggcttgcttccttcactataggcaaccttccaccctccattcctccttctactcccttggcctgtgttctcaaaaacttaaaacctcttcaactcacacctgacctaaaacctaaatgcattttcttctgcaatgccgcttgaccccaatacaaactcgacagtagttccaaatagccagaaaatggcactttaaatttttccatcctgcaaaatctaaataattcttgtcgtaaaataggcaaacggtctgaggtgcctgacgtccaggcattcttttacacatcagtcccttcctggtctctgtgcccagtgcaactcatcccaaatcttccctctttccctcccgcctgtcccctcagtaccaaccccaagcatcactgagtctttctaatcttccttttttacagacccatctgacctctcccctcctccccaggctgctcctcgccaggccgagctaggtcccaattcttcctcagcctctgctcctccaccctataatctttttatcacctcccctcctcacacctggtccggcttacagtttcgttccgagactagccctcccccacctgcccagcaatttactcttaaaaagatggctggagccaaaggcatagtcaaggttaatgctcctttttctttatcccaaatcagatagcgtttaggctttttcatcaaatataaaaacccagcccagttcattgctcgtttggcagcaaccctgagacgctttacggccctagaccctaaaaggtcaaaaggccgtcttattcccaatatacattttattacccagtctgctcctgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacttccaaacgcctgaaccacagaagccaggcgttcctccagaacctcctcccccaggagcttgctacacgtgccggaaatctggccactgggccaaggaatgcccgcagcccgggattcctcctaagctgcgtcccatctgtgtgggaccccactgaaaatcagactgttcaactcacctggcagccactcccagagcccctggaactctggcccaaggctctctgactgacttcttcccagatcttctcagcttagcggctgaagactgacactgcccgatcgcctcggaagccccctagaccatcacggatgccgagcttcgggtaactctcacagtggaaggtaagcccgtccccttcttaatcaatacggaggctacccactccacattaccttcttttcaagggcctgtttcccttgcctccataactgttgtgggtattgacggccaggcttttaaacctcttaaaactccccaactctagtgccaacttagacaatactcctttaagcactcctttttagttatccccacctgcccagttcccttattaggccgagacactttaactaaattatctgcttccctgactattcctggactatagccacatctcattgccacccttctccccaacccaaagcctccttcgcatcttcctctcatatccccccaccttaacccacaagtatgggacatctctactccttccctggcaaccgatcacatgcccattaccatcccattaaaacctaatcacccttaccccactcaacgccaatatcccatcccgcagcacgctttaaaaggattaaagcctgttatcactcgcctgctacagcatgggcttctaaaacatataaactctccttaccattcccccattttacctgtcctaaaaccagacaaggcttacaagttagttcagaatctgcgccttatcaaccaaattgttttgcctatccaccctgtggtgccaaacccatatactctcctatcctcgatacctctctctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagcccccattacttcagtcaagcccaaatttcatcttcatctgttacctatctcggcataattctcataaaaacacatgtgctctccctgctgatcgtgtccgattaatctcccaaacctcaatcccttacaaaagaacaactcctttccttcctaggcatggttagtgcggtcagaattcttacacaagagccaggaccacaccgtgtagcctttctgtccaaacaacttgaccttactgttttagcctagccctcatgtctgcgtgcagcagctgccactgctttaatactgttagaggccctaaaaatcacaaactatgctcaactcactctctacatttctcataacttccaaaatctattttcttcctcatacctgatgcatatactttctgctccctggctctttcagctgtactcactctttaagtcccacaattaccattgtttctggcccggacttcaatctggcctcccacattattcctgataccacacctgacccccatgactgtatctctctgatccacctgatattcaccccatttccccatatttccttctttcctgttcctcaccctgatcacgcttgatttattgatggcagttccaccagacccaatcgccacactccagcaaaggcaggctgtgctatagtacaagccactagcccgcctctcagaacctctcatttcctttccatcgtggaaatctatcctcaaggaaataacttctcagtgttccacctgctattctactactcctcagggattattcacgccccctcccttccctacacatcaagctcgaggatttgcccccacccaggactggcaaattagctttactcaacatgtcccgagtcaggaaactaaactattagacctcttagtctaaatagacactttcactgaataagtaaaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttctcttctcagaattcaggcctgtcctcagaatgctacaaggtgtacaggagcccatttaagctcctgtatagatgctcctttttattaggccccagtctcattcgacaccagaccaacttagactgtgcccccaaaaaaacttgtcatccctactatcttttgtctagtcatactcctattcaccattctcaactactcgtacatgccctgctcttgtttacactgccagtttacactgtttctccaagccatcacagctgatatctcctggtgctatccccaaactgtcactctaaactcttgaagtaaataaataatctttgctggcagggctatgctgagtctccttaggcactctctaatcagatgtcctgggtcctcccaattcttagaccttttatacctgtttttctccttctcttattccatttagtttttcaattcatacaaaactgtatccaggccatcaccaataattctacacgacaaatgtttcttctaacaaccccacgacatcaccccttaccacaaaatcttccttcagcttaatctctcccactctaggttcccacgccgcccctaatcccgcttgaagcagccctgagaaacatcgcccattctctctccacaccacccccaaaaaattttcgccgccccaacacttcaacactattttgttttatttttcttattaatataagaaggcaggaaagtcaggcctctgagcccaagccaagccatctcatcccctgtgacttgcatgtatatgcccagatggcctgaagtaactgaagaatcacaaaagtagtggaaaggccctgccccgccttaactgatgacattccaccattgtgatttgttcctgccccaccttaactgagtgattaaccctgtgaatttcctactcctggctcagaagctcccccactgagcaccttgtgacccccgcccctgcccaccagagaacaaccccctttgactgtaattttccattaccttcccaaatcctataaaacggccccacccctctctcccttcactgactctcttttcggactcagcccgcctgcacccaggtgaaataaacagccatgttgctcacacaaagcctgtttggtggtctcttcacaccgacgcgcatgaaagtctcgatctcctggcctcatgatccgcccgccttggcctcccaaggtgctgggattgcaggcgtgagccactgtgcccggccaacactctcttaaattaatcactttgaatagtaaagtaaaaaaaaaaaaaaaaaaatcaccagctcatattaaaaagccatttatgggccgggcacggtggctcatgcctgtggtcctgggattttgggaggccgagatgggcggatcacgaggtcaagagatcgagaccatcctggccaacacggtgaagccccgtgtctactaaaaatacaaaaattaaccaggtgtggtggcgcgtgcctgtagtctcagctactctggaggctgaggcaggagaatcgcttgaacccaggaggtggaggttgcagtgagccaagatcacaccactgcactccagcctggtgacagagcgagattccgtctcaaaaaaaaaaaaaaaaaaaactcattcataatccgacctttacctcctttacctaaatatgttcagcttcacctgtccctcattccagcctcttatttctcagctttactgaacttatatcaatatttctcagagatgaatgaattttcatgctttcatgtcttttttcttctcacccagaatgctccttattttctctccgagtcgtggactctatgcctgctcatgtgtcaagacgtagctcaacttccaacttcactaaaattatcaacctcacggtgggttctcagctagagttaggccttcccatagctctaaatctctagcacttaacagacaacattttaggtagttggttttgcattcattgtctttattggagtgaaagctttctaaagaaaaggaaggtacctaaatatttaacagatgtatcaatacctaagactagactatgcaagtggctctcctgggtgaattaataaatactcaaataaatacttgaatgaagagaagagccaaggagcacccacgccagaatattcaagaaaagtatttgataagatcattttgcaagagtttatgaggtatatccaggaaacacatattaaatgctatttgaccacagattccataaaattatgcagagaacaaaagaattatagatcgagaacttctccaacagtttctgatgatctggtgaagaaatcaatgtccacggtcatgaaataataaaaaagaattcaatatatgacaattatgaaattaattatgaaattaataaaatcttattaaattatgaaattaaaaaaaaaaagaaaatgcaaatgaaaaccccagtaaaatactacctcacgcactctaggaagtctataataaaaaagtcagtaaatgttggtgaggatatagaagcctcatacatgcttatgggaatgtaaaaaggtcctcaaaaaattaaagatagagttatcaaatgatatagcaattccacatcagtgtatacctaagagaaatgaaaacatgtctatgcaaagacttgtatagaaatgagcataatggcattacttataatacctaatgtgtgtaaacagctcaaatgtccatcaactgatgaatggatgaacatttgtatttccatgcaatgaaatattactcagctataaaattgaatgaagcattgatacatgccacaacatggatgaatcttgaaacattatgctagtcataaaatatcacatattatatgattccatttatatgaattgtccagaaaagacaaatctataaatgatagaaaatagattagtggttgtctagggctgggtagggagtggagatgaatgtttgggggttgatagctaacgaatatgggttttctgtttgaggagatgaaagtgtcctaaaatttaccatcatgatggctgcacatatctattagtatactaaatatcattccattgtacactataaatagataaatcatgtggtatatgattatatataaataaagctgttacaaaatcatatactcatttgaaattcaaatttaactgggggtcctgtatttttatgtgttaaagctggcaactgtattttaagagaaaagtgctaatcacccttagcaagtacaattccctttttctcagtgctgccactcttctgtcttctttatcccagaggaactcctctgcactcctccagtcatatttgtcttgctgtcagaacaacctgctcttcctatccttggtggctagatcagccctgctgcaggatggaagtctaacttgtattctgctattgtgagaattaaattccctttaatgccctgacattttaaaattttcaaaatgaatagaaaaggttttgagcaaccccatatagtggtttcttcccagcttgagtaatattatttctttaattaaggttagctatgaaattaagaggcattttaaggattttgactttttcccacttttccttttcaaccagtggctctcaaacattgacgcatattaatgtcacatggagacatttttaaaatccagatgcccaagccacatcccaagccaattaacttagaagctctggaggtggggccctggtatcagtaagttttaaagctttctgtgtgatctttattgtatttatccagatgcaatattcatacaagtcacccagaaacttgtaaaactacagattctgattcagtgaagccaaagatcctggatttctattacggtccaagtagaaagcgaagctgttggctcatatactattatttgagtatcaaagctgtacagcattaaagaaggataatggaataggattgcaaatgtggaataagttatggaggctcactcttagtaactctactgtgcccacctgaggcctgctgctttaaaagtctagggttataagtttaacaacagcaacaacccctttttattaagtgattactacatgctttgtgctccacatacattactttatttatggctcaaaacatccctatggagttgtccggcagatgctattgatgctccaccctatattttcttggtcgacttctgagttcacctcaaaccatagtgaatagctcccatacaagttgcctaccttcagcacctgagtccctcagctcctttgcctgagggctttctccaaagccacaggaatgggctcagccccatgcagggaagcatggaatgccaagcactggactatcatgatttgtttctaacgtacagtttgaatgcaagaatgtttatagcagttttatcaataatagtgccaaactggaaacaatccaaatgtccatcagcaggagagtggataattcaattacagtttattcatacaatgaaatcccacatagcaataaaaaatgaactactgctgcaggcacaacgtggatgaatctcatagacatatgtcaagcaaaaaaccccaacaatttatgaaggtcaagagcagacaaaactgatcaataatgatagaagtcagaatagtagttatttgaggacagcagcattaggggaaaagcgcattgattagggtagtggaaatgttccatatcttgacctgggtaatggttttatgggtgtaaacatatgtaaatactcatcaagcagtactcttcaaaatttgtgcacttgatgcaccctcactgtatgcttgtcactcctcgtcacagctgctatggcagatatggcatctttactgatcggttcagcacatcccctggcacttggtatgcagttattgatttagcgaatacattcttttcaattcccaacaggtaagaggatgaaaactgtttttacttacataggaagaatgacagaacacatttaatttcttgtcccaggactaagttaactttcctgctttctttgataaaacatattccaaagggatattatttcttttacattcacagaacattgtttagtactccactatattggtcacattaaattaactagacttggtgagcagaaaatggcaagttctctggatgacctggtaagacaaacatgtgtcagaaggtgtgagaaaaccctctccaagatccaggggttttccccatatgtacagtttgtagggatccaatattcttgggcatgccaggacattccctccaagaaaatggacaaatcactgcacctacataaagaaaaaagagcagccttatcaagccccctcagggaatctgtcaccagcagtaccatgccaccccctcagaggtctgggtcctaactttgtaggtcccctccttcaagcttctacattttaaaaacctcatctttcccttctttgtccagccccaggggcagtagctgcttcctacttccgcagatattatctctgttacattagtgttcccattctgcctttccagttctccaatgactgtttaggcaatgtgctgtgaaaataacgagtatggtggtttccttcttccctttcttcctgttaggattcaaccagagaaatgtaattagtaggagatttattgcaaggaattggcttatgtgattgtggggcctggcgagtctgaaatgggctgggcaagccatcagaaacaacaggcattaggaactctctggcatgagctgaagcttctatctgaaggcggaatttcttttcttcagggcagcctcagttctgctcagtctacctctgagttcccccaaagctgtggtagacatttcccatacacagtgagagtttcttacattaagtgtcaaagcacctctgttgctttccctgagggctttctcaagctacaggagtatgtgtttcacatgattcttctgaagtgggattgagccctgttgtccatggtggtagcctgcctattaatgcactaatgcactctctattagcatttctctcatccttgactcactttccccactccctgacttgtgctttctggggccacttccaaataaattaccagcatccaagtccattattcaaggtctacttttgaaaaaacactaactatgataagtaagcatcattgtcaactccattctatgtcttcctttattccataccagccaaaatgatctcttaatttaattatatcaagttactcccctacttaaaatctttttgtgatgtcttaacaattagaataaacttcaaacttttaactaaggcttaaaatacctacctggactgccctggcctgggcctccaatgtcatttcccattacggtcccctcactcactttcagccacactggccttctgcttgctcctcagtcacacaaggtcatcctttgtggggctcatggcctttgcatctgctgttctgtcttacacattctcacccacatttttacatggtggccccttctcaacattcagacctgtccgaaatgcctcttcctcagagagaccctcctccatcaccctgactgacataacatcctgtcttccaggacttgcaaacctattactctccctacaccacgagtatctttcttttaggactttataccatctgaagtgatctttgactttaactgccttattgtctgtctctttttactccatgggcaaaagttggtctgttttgtccactttatccttagggctcagaatagtgcctgggatgttgcagacccttgtgaaagatgtggtgaattaatacatgattataaatatgcacatagcttaaaaacttgagtctctttaggcaacatctgtgagcagggataagggataacaaaagtggagtaaacatttttacaaacactggagttggggttcaagatacagagaggtcaaggttgttcctatgcctatatggatcatgaaatgatcctagttaagagtaagaacaaaacagatgaaaaatctttgtggtttaggtgggagtgactaaaggattggtagatgacaagtagagagaaatgaaatttaaaattaggtctttagattttttttttcaaaaaatcctccccctgtcctcctcacaccaaatattcattgtgttgttgatgccaatggcaattcagtaattttattgttagttgtaggtttccctaatctatttcaaacatagaataggccccacatatattatgtgctcaataaatacttgtgtagtgtgattgttaattttaagtgttagcttgattgggttaagggatgcccagatagctggtaaaacattatttctgggtgtgtctgcagggtgttggtggaagagacgagcatttgaatcagtggactgagtaaagaagatccacacttaaccaatgtggggggcagacatcatccaatccattgacggcctgaatagaacaaaagtcagaggaaggccaaattcttgctctctatccttgagctggaacatccagcttctgctctcagacatccaagctcctgtttctcaggcctttggcctcaagctgaattataccactggcttttctggttcttcagcttgcggacagcagatagtaggacttcttgtcctccataaacatgtgagctaattttcataagaaatctcttatgagattatatatataatatataatagtcatggttctccagagaagcagaactaacatcctagaaacaacccatgcagtagtcagggttctccagagaaacagaagcctatgagaacagggtttagagtgattgtgtaacttgcccgaagataccaactaaaatactgacagagctgagatttgacttcaagttccattctcttaactgttaaacaatactacctttgtctaaagactaattgagccaatagacttatgtggagtttttttttcagagttgcatttgtatatgtttaaaaatttctccaaatactttgaaagtaagatctgaaaatcaaacagatctttggaaattttgcagctgaaatggagaaggccaggaagcatttaaaccagggctatggttaatgttatttgtagcctgagaatgtgactgagggagagggagcttacaggctgctttagctgggctcactctctcaacctcgtagggaagtcgtagtggggtcttactcagtgagagtgaagcctccggaagttctgttccattctctctactcattattcagaccttgtctgtgtcatttaatctttcagtttgttgctccataaaatgtgaaaaaaaaaagtagcaactggtctgatctttcataagcagctactctgaaagcatacttggaagtgcttgcagctctttggaggagggtgaagtatttactggtattatgcctgccttccgtaggcttaccttgacaatatctatgatgtgtccctagtgtgccctgatgaataaagatcccgaagtgaaaaatgtaaagcaatatggtctgtggtgaaaacacccatcacacatcagcccatcccatctgaggtccaaacttttcctggccctgactccttgctatcaagtagaggagatatatttaccagagaaaattcagggtatctgggtccagtgtatactatctggaattgccaagcctaagacaaaaatcctgaagtaatcctgaagctatttctggccttgggcacaggctttgtattatatgagcatttaaaatttcagaacactttcacttaaggactcatgtattccttaccacaagccctcgcctcagttttcccaacagtaaaccagaagcatggcctgtaatgactgttcaagtaatatcattatctttcatttctccaaatttccactcctaactagaaatctctggagagatcaagcaaggcaaaaagaaatctgtccagtcttgcttgaggtttactggtttcggcgtggtctgggaagtggataaatcattggtcccttggcctgtgtctctctcactcaagtcaaacacaagttgggaaggacgtaccaagctttccgagaggcaggtttcccataggaggctgttaatggcctgtcatgtgctttttttggcagagcagtgaggaactctttgagagcctcaaacacactgggaaccccaaaataaaaggaattagtaaccaagattaaaattgtgttgcagtggtttgcttcagtgctgaggctctcaactgtggtaactctataaattcaggtggatttctcagcaaataattcatctccctggcctacatgacgggagaagcactcagattgagtgactttcttttccccttggactctcaatgctcacgcacatcctcctttggatggtaatactgcattcatgctgaaagacatttttgcttcaataaattaaaaatggtaaggatcggcttacattctttctttttatattttcctaatgaaaaatgaatatttgattctctgttgtattgctattattcatatcccttaaccttttatttgatgtgcaaaaatgtcgtgttgaaaaactcaagggccacagactagtagaaacaaaaagaatatttattttcatttttcatgtgatattatttcagagttgttgtaataaccattttctcttgtaataaaacattttgtttaaaaaccatcctttgttatagttcttctgtcctataaaagtgtcaaaaggatgcttttcctttctatacttcttttgacttttaataaaaggccaacaatctcactaatctatacatgttatttaagaatatatttcaaaaaatgaaaataaaatcagttgaaacaaatcccactatgtgcaacaatagaaagaagagtttaggctggcttaagtgttcaaaaatatcatggcttaatcaaattcaggttcttgaatatgatgggctttttttccaggtgttgaaaacctatcatgactttcctttttatgaacagcatttggcaaccatttgacaattcttataatagaactcagtgggaatatgaagacaaaggctttggaatttttgtaagcacaggaaggtacatctcctgggaagtagagctatcacacaataatcaattcatgcaaaaagcagagaaacacacacatacacacatacacacacacactcaaatatctatatgggaaaacaagaaatctggaaaaaaaaaaaaaggagcctcatgtccaatgtgtgtggcagctaacctccaagatgactctaataatccctgcctcctggtgttcatgttgtagcatagtcttctcccacattgagtagggctgactggtgtaacaaatagagtatcattgtaatgataatttgtgacttccaaagctagattataaaagatctgtgacttctgctttgctctttcttagatcactcactctgagggaagccacctgcccagttgtgagcagccctatgggataaagattttcttgttttcttttttttttcttcaacttttaagttttggggtacatgttcaggatgtgccggtttgttacatgcataaacatgtgccatgggggtttgctgtgcacatcaacccatcacctaggtatttaagcccagcatccattaactattcttcctgacgccctccctccccccatcccccagcccgggcccgacaggccccagtgtgtgttgttccccacagtgtgtccatgtgttctgggatgaggattttcattgcagcgtatttgtggtagtgggtagttggaggtaacccaggtgtcaatttttgccaaagtgatggacaaagtgtagtgatcacttaacattaaatacaatgattaaacacaaaagattagaactacatacatcaacgtggttggatcttaaaaacagtgtattgtcagaaatagaatgcaacatacatcattcatgtaaataaaaattcacaaaatgacaatatacattttgcaaggacatactcacatgaaaatatatacgtaaaatatgttgaaatgcatgtctattgcaagaagaagaaagatgaatatggtatggagataaaaaataaattaatgaattaagcaagagaggggatcttactaggccttgaattgagggatgtgattaactcaatcctttgcactagaggtccaaaactagttaagaaaaaaagttggaaaaatacacttagactttgaaaaagagggcatatgaaagcgtggtagtaaaagagaagaggagcattcaacgacaccacagaccagtttcaaaacaaggtggtgtctttgacacagatctgggttgctgttccaggaatgaaaagcatatcaatagcagggtttggagagggtgattccaactgctaatcaagaacttcctgattttagcctccaccataaggtccttgcatctatatgtagagaacacattgcagtgtaaagtttcttgttaatgaagaagggatatgaaaaagaagctcagaaaatagtgtctttattttcaaagacttttcaaaagtaccctttttgttgtttctcaatcactaaacgtttgcttcctgagttatcagtacaattctaaaccagcccttttgtctattctagaaaggaaatagtcaaatatcttggggaaaactgtataattttaattttctgttgtcaaatgagattgtgacctgacgtttagttccattatcacagctttaactgtattttatgttttaaaaaatgatggagactttataaataccacaggaaaatttagaaatccacttcttactgcatcactctaatataaaaacggcttttatttctttggttctcccctgagctttatgaattggcctaatgaatctcaaatatcataagcataggaagccttgggggaagaggattgaggtggcaacttttcaattcaatttttgcataacttgaacaatatgctcaggattgtgataagcccagtacaaagggcataaaaagttagaatattcctgtcatgagggaaattacatgcttctagaatggataagaattacaacattgtgaaattccccacccccagctttactgaggtgtaattgacaaataaaaactgtatatatttaaggtacagaatgtgatgatttgatatacatgtactttgtgaaataattatcataatcaagccaataaacacatgcatcacctcacataattatcctattttttcctatgtggtgagaacatttaagacccactttcttaccaaatttcaagtacgcagtacagtactagtaactaatagtcaccatgctgtgctgactgttggatcccagaacttgttcatcttataactgaatttgtacccattgaccagcatctccccacttcctccactgcccctaccctccagcctctggcaaccaccattctaccttctgcttctatgagtttggcttttttagattgcacatataagtgagatcacccagtatttgtcttgctgagtctggtttatttcacttagcattatattttccaggttaatccatgttgtcacaaatggaaggatttctatctttattatggctgaataatattccattcaacacgttttcattatccattcaactgttggtggacacttagattgattccatatcttggctattgtgaataatgccaaaatgaacatgagaatgcagatctctctttgagatactgatatcatttcctttggatatatacccagagtgggaatactgggtcatatggtgttctagttttaattttttttaggaaactccagaatattttctataacagctgtaccaactattgtgaaaaattaaaggtttattcaacctagtgttgttgatgtccaatcacatagaccctcagcctgctctgagtttacctgtggccacaggggccagttcctaccaagttgacagctttgccctgaatgggtttctctctgcttctttgctggctctctctggcccagcaactgcatgcagggaagctgaaactgtgtgcagggaagctccaggagtgttgggggtttacagccccaggggtgaccttcagtgtcagtctcctcaagcctcagagccttcagtgggtaagggccacgttgccatcagtggtaacttgttctttaatgcaccatttattggctttgcccttcccttgcttacccactcccgtgcatgtgcttcctcagaacacatcctaattaaactaccttcattcaaatctttgtctcaaggtttgctttagggggaacccaaataaaacatatcagacagaatgtagtcaaatgccaagatgtgtaaaaccaaaattttcttcccctccaactctaccacttctcaattccctgtcgatggaacaagacataaaattaatgcaatcagcacaggttcccgtttgcctcacctcttgctggttgcccttgaccatttgagaggctggctgagaatgaagttgccacagtagacagccctactatatgccttctttttattgtcaatttaaatgtgacctttctagctcaggcagtgacacagtctaaacacttctattcttcctagatcttggcaagtgcagcaatctgctatccttctctttttccattcgtctctttttcagatttattcattttctctaccaactatctattatgcatatggtctgtctgaagtacattaggtcctggaggtgccccaatgcccaagacagtcgtggttcatgagctcccattgcttagagctcagggtactactgtagcaggcatcatatatggtgtgggaatgctgtgaaaaggacagcatgctatggcagcacccaggaggccacaatactaagccagagtggggtgggggcgggggtcaaagaaggctacttaggagaaaaaaaaataggctttaagaaagtcagaagaaagggatatacaggagccaaactgagtattgctcaaaagaagagcagcagcaggaggtgattcagctggaggattaaaaagggggcagtctataaagagccttgcagaacctttctaggactttaccctaaaacaaaatctctcaaaggaatttaaactggaaaagatatgaccagacttacattttaaaaatatctctgactgcagtgaataaatctgggagtgaccagacttgacagactagttaatgtagatgaagtgatggtgaccaaggtggagcaggaagtggcattgggaggaaaaataattgaaagcaattgggagacattgaggtagtggaattgatagatttggtggctaatgatatggagaaggtaagagaaaggggggaatcaagaatgataattattttccagtttggcagttggtggctggtggggctgttccttaatacaaggaacaacagaaggagccctgtgggagcattgaccgcagactggaagagagtactgatgatggttgtcattttggataggctgtgttgttgagtttgaggagcacgtgaagaaagcaggtagaaatatctaatcttcaggcatgtctggagtttaggggagagatctgggctagagggaggtgagataagcatctttatgaggggttatcatctatgctacaggtattatttaagaaccttgctgcagaacaccttgatatgcaggaatcaaacatccatcatcatggcagtttcgcttcaagaagggtgtcattcttatcatgcaacagactgttttcctgcacttatatattactaaagactagaaaaacagagatggatcagtttaggtggagtggctagaagccagaaggcagaagatcgtagagcaattagaatgtgaaaaaggaaaaacagaataccctgaagaagcgtgactctatcaatgatctattgcagtgtcacaaaccactctaaaacttagtggctaagacagtgacaattttatttgcttataattctgtgggtcagcgttttgggctgggttcagctgagtagctcttctagtttctttggcagtttagtctggatgacctaacatccagaccaaagatgtggtcatgggttgtgtgtgtcctctctcttcaagacgccctcactttaagagaataacgaaaggcagttgcagcagctagcactgatttggtagaaggcacccactatatgccaaatattgtgctttttgctaggtctcccatggccttattaccatgctgctgaaaaccttagagaggttcatctgctcaaggagctcccagtgctggcaattggcaaggccaagattttaggtgagctcagtaatgttgaagcccatgcttttcccactactacttgctggttagttccacacttacacctcatgggcctgggggttacatgtaaggctgcaggggctttaagtggaggtagaggacaatcttggggttcagagagcactggagtatgtttggccccctgacctgcagacagccagttataaaagtagtcaatgaactaaaatctgaagtgcctagaagaggctgtggccaacaaagccactaaaatcttaactattattattgtcattggtactggtaatattttgcttcctggttcatactctggtgtcttccataccatggttgcttcctggttcatactctggtgtcttcagcatttatcagtctttgctattctccctagcttgggaaaattcctacacttccacccaattgcatcttatttcatgcattttcttatgttgagaatggaaatagctttgtagtctccatttgctaaagggagagtaccacaaaggaggagaacctggtgtgacttgttcattgatgcaaccccagcatcctgactgggccctgcacagtatgtgcttatcgaatgccatgttggtcttttaaaataaattcacctcatcaaggtatcagcacaccttaaggtgagagaggcctgggcaggggccagggagctacgcctctgtaatgcactctgaatctacaacggaccttcgtggggacacatgcttgtgtgcagaggaggtctctagaggcacacattgctgtcttcatctgagacatacagcatactggctccaaaagccccacatgcagaaagaggaatcttattttcaaatagaggcacactgctgatttcacacttttcattgctcaattaattgatatttaaagaaaaagtagttaagggatatagaaagcattgactgtgaagctacgaagggatacatgtatcatttccaacacttcacagaaggacaattcagggaaaccaagtttcttgatttcacaattccaattataaatacaacacttaggcttatccctcctcatatgcattacacttcagttacaagcatgttccaccatgcatgttgatgagtgcttgtctgggagatacctgctttagccgaccacttctctttcagaaccaaaaaccatgtaattttaattcctgaaaggatttggctatgttcttataataaacacattgtaaactgttggggcctgggatagggagaattgaaaactctactgatggaggagattaaaactcctccaaatctgcctgattgaggtaccctgtctggatatcttctgctttctgtaggaaggatcagcaagttttgtcttaatgatagtaatattttaggatttatggatcatacaatcatgagggcatataaatgaatgggtgtggctgtgtttcaataacattttatttacaaaaacaggaggcccagacttagtttgccaaacctgccctagagggaaggctatgagctccagttctctccagaatatctggatattctgaatggatgttcatcatccaatatttgctttctgtgtcagagtgtgtgtgtgctccaactggaataatttggtatgaatttttaaaatgcagagcatcagtgctgttggtgtagtccattttatgtgaagaatccaagtggaatatacattgggagggtatgatgttgtatttcttagcattacacagagctagaatgacattcacttaaatgcacttatctagaataaagtgaagaatgacagttgcttggaaatagggaagactgattgagcccatgttttggttggactaccattgaacctaattttaaaacgtaaaggtttaaaatgattagtgtggccaggcacagtggctcatgcctgtaatctcagcactttgggaggccaaggcgggtggatcacctgaggtaaggagttcgagaccagcctggccaatattatgaaaccccgtctctactaaaaatacaaacaaacaacaacaaaaaaaaaattagccaggtgtggtggcaggcacctgtaatcccagctactcgggaggctgaggcaggagaatggcttgaacccaggaagcagaggttgcagtgagccaagattgtaccactgtactccagcctaggtgacaagagtgaaactttatctcaaaataaaataaaataaaataaaaaataaaataaaataaaataaaatgattagtgatagattttcatttatccagggtttgattacttttaaattaaaaattatgaatggtataaaggaaaaataaaataacctataaaattaagctgggaatttttgactcctttaatgaatccttccaatctcaagtgaaaaccaggaacatcttatatatgaattaaattgacagtaagaatcatattatgatacttgcccctttttaaaaaaatgcatatctattgattcttctacttgcatcttattcatagaggcggatgaattccttttccagtggacttctagattcaagaatctctcaaggcctaggcctgggtaaactcattttagatcaccaaacttgcagtagtagttgacctcaatgaatagtccaaggaaatacacatatatactaagcacacttaaaatcctttagcatttgctccttttgtataagaaatagcagaggactaaggagacatgacaggtccttgtcacccctgctacggagggtgacaggtaccagaaaatgctcaggtgccacatcagatcaggcaagttaaaaagaacaatgacctatgtgaaaaaattctattttgtcagtcactttaaagtatgagttaagtgaatatttattatagactgaatgatgtttgtgtcttccctcccagctcatatgaagcccatatctctgatgtgatggtatttggaaatggggcctttggaaagtaatttcaggttagatgacgtcatgagagtagggtgctcattataggattagtggccttggaagaagagacaccagagagcttgccctctgcctcctgtgctcacacaaacaggccatgtgagcacacggtaagaaggtggccgacaagccaggaagagtcctcaccagaaacctaccatacaggcaccttgatttccaacttcctgtctctggaattgtcagaaaataaatttctgttgtttaagtcacccagtctagagcatcttgttttggcagcctgagcagactaatataaggcctgattttttttccagaatactttttcttgtcttttgaaataatttttacataacaagaaggtgctgtggtaggggatagagactgaaggaataaggaatgaggaggccagtgcggtggctcacgcctgcaatcccagcacaggggagggagctcaagcaatccgcctgcttggcattgggatggaaaaatgctatctgtacaaacaatacgaaaattagctgggtgtagtggcatgcacttgtagtcccatctactcaggaggctaaggtgggaggattgcttgagcccaggaggcagaggctgcagtgagctgagatcacaccactgccagcctgggccacagagcaagacccagtctcaaaaaaaaaaaaaaaaaaaaaaaaaaaaaagagaaaagaaaacaaagaaaaagaaaaaaaaagaaatgaggagatgcagaaaaagttcaggctctatatacataaatctatttttcctagtcttatatccgcaaaatgacttctcagcttgttgtttttgtctggaaaagtattaattcatgatattataatttcccaagttcttacataagaaattaactgtccatattttgagtacttacagacaaaatttcctttcaaaagtgctttgaaaataaacattttgttttacagtatgccacacaattatctaatgaccagctctctatgcctccctgtgatgcattccaggtaagaattaaaaacatcccaccgaagggtgagtcatgggctggacactagattcagaacaaacgcccgcaccagacttgctatgctaaggctatcctccgacgactgaacgtggccaatctgaatagctttaatacaccatggccactttccatcattcattttttgtaatactagaatttttccctcttgaaaacaaaaattattacagaaattagcaggatgtcaggtatatagcatttataggcatttcaaaatagtcactttgaaatgttgagcagattcatgatagattttcaaggctttgaattatttacattttaaaaagtttatcagatattgcaatgttaaagataaattatttgaacttctagtaggtagtaatggtgtcagagaatgacaggtaattaagtcatacagtacatcttgtgtccacatttcatgcaatttttgcagaatgctgtactatgtaaactgctactgcaaaaaaaaaaaaaaaagcaattattgcactgaattttccataaaatccctccaagtaaatcttatcacccctttgcagatgagcatcttgtctttgggaagatgcaatagaaaaggaacttgccatagaaagcagtagtaagacttcttatatgagactaagattttcatttcattagctctctccttcaccttgtttattaattctacaagcatttattgccatctcctatgtgccaagcactggtccaggctctggggatacactatgaacaaaatacagtgaagtccctgccccatggagcttacattctagtagggggagacagacaaacacataaatacaaaatatcagagggttcaaaacagcttagaggtatcttgcctgaattctgtttactgcatatcctcattcttgggcaatgataaagtgaagagagaggccaacaatgggctgcagcaatgttgctagtcccagctctaccatctacacattgagtggatttaagtgagttctcatctgatctgagcctcagtttcctcatctataaaatggggagaaattggattaaattacttataagggaaagggtcctttcaggcttttttcatgagagtagggtgctgaaaatcaagagccagtttgttgactcctctaaggtttaaaaaatatttaaatataaaatctaagaaatccttagagatcccatacactcaatacttcaaatgccaatctgaacttctttcatcaatagcaaattcttatttacaatggctatagaatgaagtcattttaccatctttagccatatgaaaaataagttatttacttataaaaacattcatttttattattggttacaaaatctcaccttatttgtgaaatgttccctagctatgagatcctgcccttgatgtgacactatttctctcttctgctaacccctatccctgactttgtgctcctgtttaatttttccaactgaagtattagctttatgaaaacagggatcggctgcttgcttctttgaagaacaacccaaatgagagtatgtccaggtaatccatagacatgtataatcattacacctgcattttgttttacaggtacaggccttttggtaacccacattagctctttagactgtcagagttgttcagcttagtaaaatttagtttatcaaagggtactctaacatccgaaaaggaaaaacacgtttccagactaattcacagactagggcattgtaacttcactggaagccctggtgagaggcgttaatacatatttaataatgtaagtgaagtagcacatattttataatcaattaatttttctcaaagaagataatgtagcagaagacctgaatgtcaaacaaggttagactcatacttactaacttggtaggagttacgatgcctctgattctcttgaaagacaaactgtattcactagtttgattttgaaatgtagagatcaaatttcaatcaacccagcagctaaggatgacaggaaattttacaggactagaaggaatcatcttctcttatctggatctgatcctcctcgacaccttgggggtttccgaaggctgtgtgctctcagttttagctggttgttacgtaatcaaatatcccatgcatgtttttacatttgatcaggtgggcctaatcacaaggactcatgttgtcagtgcctttgggagcaaaatgaaataaatctctgtctcaatattggaatttattccttcctgttgcttagtggtgtcaagatacagtgtcaatgttaccagaagtgcctaacacagtctactgtgtaggctaaagtctgccgtgttcgtacagtgactgaaaaggaataatgactatatcctcatttgggtgaatgttactacttcaggaccagatgagcaggggcatcccatgtaaccatgaagaatcttgaagcagcattacaacatctaataataaacaatctctcaaacagtgcctgtatgaactgcaagatgagggcaggtccagctagacattggctgcataaatgaagatcagagaagaataaggagattcagacaacttttggcaacctagatcacagttactggtaaattcttgttacaaaggaaatggattttggtatacggaatttgaatatgtgttttactcaacagagtacatgctaccaacaagaatgcagccccctttttacaagttaggcagaaggaattataaagtcttgctgatgtttacagtccttacatcaatgtgactgcagccctccccagtcattccaaaaggtccttgggttggatacgagaatgcgtcaggcctggctttggctatgacatccccaggaagtcactgtgtgcagtgtggtctccagggtggaagtctttgagctgccaatgaatatctcttaagtccaaacctccatgggcactatggcctctttggtcccaacagaaggcagtaggctttcttcagacaagaaataaaaggggaattgcaccaaaaatccacggatcttcttcagttcctcctcagctcgaatgggatcttccttagctaatacgggcttgtttataaagtctctcagctgaattaaattgtgtacttcatcattgggaaggcaccggaaaacctgattagagcataaatagaaaaatgagtgaaaagtttaaaagcgagcacatggcctttatggaaaataattattccaacagacaagacctctgttgtatgaaacatattattagtcttatgttacagcacagacctgatttaagagttggttatcttataaccaacaatagatagatctgctacaaacagatagatctgcttccatttaaaaaatcatggttagtggcaagaaattacactaatgttaccccacattaaggttaattttttttggataataatcatccctgaatttcactggagcttctggtctaagaggaatattgcatattatattttccctaacttttcttgaaagaggctcatatctgtacctttacatagcattatcaattgttaatatgtaacacttactttgctggttgaaaatgagttttggatatcataacacttcacccctgaatacttctctgcaggtatgtcttaagaataaggacatgtgcctatataatcacagcactattctcacacctaagaaaattaattatataatgtcatttaagttatgcttcatattcagatttatcctgttatccccaaaatgtcttttatagatgttttcccccaaatccaggacccaaataaggctgtgcactgcatttgtaaaattacattttaatgactctatgcacatgacctatttgatcatggccttcggtccatgaaataaggatgaaataaggttatacaggggtcaggcgcattgggtcatgcctgtaatcctagcactttgagaggccaaggcaggcggatcacttgaggtcaggagttcaagaccagcctgtatcataatacaaaaattagctgggtgtgctggtgggcacctgtaggcccagctactcgggaggctgaggcaggggaatcacttgaacccaggaggtagaaattgcagtgagccgagatcatgccactgcactccagcctgggcaacagggtgagactccatgtcaattaaaaaaaaaaaaaaaaggaaagaaagaaaagaaacaaggttatacagacagtagacatgtttcattaagaataataagtttctctgctggaaggggctctaagagaaaaattgcgtattttccctaatttttttttttaaagaggttcacgtctgtccctggaagtcatgaagaagaacacagacttatccaacttctcacagatggtcaattagtctgggctagaacacagcttgaatagttttccctgatgggcaactagctacttttcgaagtaagctgttctactgttacgcaactcttaactcttttacattctttattataaccaaaggatagacttcacaggcaatgcatttggtatgcatcaaatggagccggttttaaaacacctttctaaaactagagctgtccaacaaatgacatgtcttgttattaatattaacaagattcatcataaggatgaatactgtttactatacactatgtgctaaaaccattcactagactattctttgtcctcataactacccttgtgaatattcctcccaatttataggagaggaaaaagaaactcagaaagttaagtcactatacacaaggttataacaccagcaacggggtgagctaggctggactcagctgtggcttgtttttttatgccatctgcccctcttctctttgtcactagacatgtacaaaggctgggtaaccaggtgctaaggatgctgctgatgggattcctgcatcacaggagagactggaatgctgctaaagcctcttctaaaccaaaatccacaatgctttttgcctttgtttttcagggtccacaaagaggtattttattacaacctggacatgtattagcttttttacgtttattaagaataccctgtaccaataatatgcagaaataacaatatgctttttgtgatgagattcagtgaaaagaaacggaggaggggaatacgtgaacttcaccttgtcataaattgtagcatttcgagctgctgttgaaacccacacctccttgaagaatttgtcactcactggatcctgaatgtcctcacttgggtcatcaagatagccaaggacaaccctgaaatacaagtgacctccacattgagtaactgagataaagcagtttgttgcaggatatatgtctattatatctatctctatatatgcaaatatatatatgcaaattatttgagagaccatgacctagctactctcatatcctcagagtgcctgacataaaagaaactattgtctgaattgaccacacataaacagcggactagacataacaaaaaattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatgctcataggctgaatgtttttttctgagttcaccaaataagtgagtatagacagagaagaggaccgggtgtatatcaacagtaagggagaggaggaggaaccagcgaggctggagaaaagccagaggatgtggaatcctgaaaccacacaaagaagtatgtcaaggagaactgtccaattcagataagaattgaccaccggctttaacaactggacatcattatattgttaccctccttgtatttaaataaatgtagatttgcatcatcattttaatggctgcagagtttcctatcacgtgaaatttattgaaccaattatttcattatggacttttgggtaatttccaatttttcattattataaacagtgttacaatgaacacagtttattcatcatatgtgattttgtacatttctgtgattatttcataagaagaaattttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacgagaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggcaatatattattttccctggcagtattttaattataagaaatttatattaaatgcagagtaaaaataatatgaagtactctggatgttcttttgaggactaaagtttgagagaaaactagtttaattttatgttgatgtatttaatgaaaattatttaatatttgcttattcatcaaaaaaagtgggacagtaggaaaaccacaaaaaattatttctgttctttccgttcctcatatctatcactttaaatgattctgagtcctaattgtgtggacaatggtttctcttgagtgatggttatatctgcaaagtttggataattttctaggacttgaactgttcagcttatagctgtgaaatttagtgcatgtttgattctgtctctatttagaattgatttcacattgaaataagtctctctatttctattttaaaataggccagatggaaaatggagtgaaactgcattttttaagtgaaaaaaatggttgtagtctaggccacaatatttatctttgggaatgtttcctaataaaaagaggctaaaattgacgcaatgtttttgtggtgcttttaaatatattatctgtgtttgccattggggcaaagtgaaaataattattgaagaacaactgcctctttaacacaatttgaaaaatgcgaagtaaaagaaagcacctagaaacaaagttagcataagatcagcattaaaaaaatgaattatttactgtagaataatcttcctccccaccaataataaaaacccaaagctttattgaagaacaataaaatattcatataaattgaagtccataccttgttcttcaacaagatgactcaatattataaaggtgtcagttcttttcttcatctataaatccgctataattccaattttataaaactagtaagaacttgagagaacgtgagtaaacaattctaaagtccatgtggaagaattaatgtttatgaataaccaagattattttgaaaaagaatactaatttgaagaagtggtatggcaaaaagtagtcttaaaatgcacagccacaataattacatggtatcacactggcatgcaagtaaacagactttcaatatggcataacagagagactagcgagaagccagaacagatagtgattcagtgtatcttaaaggtggactgcagataagagaggcgaagagtcctactacgtatcgtaaggttccagatcatctggttagttgagaaaaagagtcaggaccccgacctcacttcttacactaaaatacactgcagatgttaattgtaaaaagtaaaaccaaacaagcaccaggagaagacacaagtaaatgtttaatcttaggctgaggaagctattctaagcatacagaaaaaggcaggtggggaaaaaaaagaaaaaaacagattgatttgattaataagaattgaaaaatttcccccaaattctccaaagatgactaaaagccaacaggcaaacaaaatttgcaacacatatgacaaaggaataagcatcctacacatatttaaaatacttataaatcattaaaagaaagttaaacaacaaccccattaaaaagtgggcaaaagacaatggaaaagacatttttgaaaagaagacacacaagcagccaacaaacataaaaaaatgctgaacatcattaattatcagataaatgcaaattaaaaccacacaagataccatttcacaccaatcagaatgactattattaaaaagtcaaaaaacaacagctgttggtgaggatgtggagaaaagggaatgcatatacactgttggtgataacagaaattagtataacctctataggagacagtatggacacttctcaaagagctaaatatagaactatcattcaatacaacaatcccacaactgggtatctacctaagttgtcctaaaaatgacacctgcacttgtatgtttatcacagcactattcacaatagcacagtgttggaatcaacctaaatgtcctgagcagacaattacataaagaaaacacacacacacacacacacacacacacacacacacacacacacacaccagagaaaactactcagccataaataagaatgaaatcatgtattttgtagcaacatgcatggagttggaagccattatcctaaatgaaataacagaaagttaaatactgcgtgttctcacttataagtgggagcaaaacagtacatacacatggatgtacagagtggaataactgacgttggagactccaaaaggtgggtgggtagaggtggagtgaaggatgagaaatcacctaatgggtacaatgtacactatttgggtgacagttacactaaaagcccagacttcacccctacacaatgtatccaggtaacaaaactgtacctgtactccttaattgtataaaaataataaaaaaagaaagttaaaccttccatcgtaatgggcaaaggatacaaataaactaggcaatttatgaaaaaaattatacatggctaataaacatatttttaattctaaaaaatgtgaattaaaatggtgaaattccatgtgaaatctaacaaattggtgaagattaaataaactcagtcaagatagaaggaataagccctctaaaatattgccagtgatataataagagatcaaaggagacaataaagaaggtgaacaagaaggtatctacaaacatacccatttttttatatcagcaaaaatatctgccaaacaatgagggattaaaggaattatggcatacacatacaataaaatataatgtagccattaacatattgtagaagaatactcgatgacatggaaaatgtgtgtaacattgtttaaataataaaaaacatgtaggcctgcaaaattctaattttgttttaaaaagggaatacaatatattaatatctatgtatagaaaaaagtggaatgacatataccaaatgttaaaactgttatcacaaggtgatggtattacagatgaatttaattttcttactggttttctgtatttgccaaatttgtacataaaaatgtgctgtaatcaaaaacctctaccttctataattattacacatttaaaaagttataaagaaactcatgactttaaagagaattcttaagttcttacggaactgaaaagatataacatacattccagcttacaaaaggaagtatttgtcttttatgtatgccgcagtaggcaatcaatgggttaattagcagggtaccaatttttaaattctcctctgctaaacaaaacaaattaccattagaagctaattgaattatcaatggtttgaaaatcttcttactggcaaatcaagtagtaacaaaggcaataaatacagcaataaaagttgttagaaggtattgatagattttgagggatggattttttgagctacttagacagagacagcagaatgtctctacaactgaggcttatgttggtcttggaagccgaagtctggattggtaggaatgagcgaagtggcctctgcctttgccgggagttaagtgctcactaagcgcccatctgcaagtgagccagtttccaaaagggaccatttaacacaaagaaaacaacaggctgcagcgcagtgcccttcccgaaagggcataacgcactgatcttaactatatcggggccacctgctgcatcccactatacagtcctcaccaaaattgcattatggcaaatatagttctagaatcataaaactgtggacttcctacaaaggcctagagttgggagagtagtcagggtgttccacagccggtggggaaatgagtgtctgcagggagcaagggaaacagtgaaaggagacgagattatattacttgttccttgtgagataagaagccattggacagtagtgagcagagaagcaacatgatctagaaggttctagagggaccactgtgttgagaaaacacaacaggggacgtggacagttacagcgcagcccttgaaagttctaaataacactttattgaatggacttatttaggatcgcacagctgaaacgagcccagcttcctagcccagtattctctctgcttcaccacagattagtttaaaatttgcatcttcttgccaaagatcagggatcttcgacacctg

SEQ ID NO: 835 - DNA, 13562 bp, Homo sapiens
ttcatgaatatgattcaattgcacaaaacattcacagagacctgaattaacttctgcccgcctccactcctgccatatgaaccatggaaaagtgcagttcaagaaatgcaactgagacactcccaaaggaaagacagctcaatctctatcccagggtttctcagcatagcattggacagattcacctctgggactttctaaaaagattcaccccaaagaatctacatgacacactgtggggcagcccacctctcaaaatttcaaacaaagcaagatgcgtaggcttcagggatttcagccttgaattcatctccccaggccccacttcttccacccacccacacttagcctaacttctgtcgacttaacaactgaaatgtctcttccttagaggactcaggaggttaattatgcagactttctcccaacatccattttttttaattttcattacattcatccacttcttatgtgtttgatgactgttgcatatcagctttccaaggatgggaacggatctgccttctctccactgcacatgaagcatctgattcagcccaggtggattattacagagtttactaaaagacacatttccttcaaatgaagaaattacagtcaatttaataaaggaggcgattttcaggccaggctaataaactttttactttgattgtgagacatgatctcactctgttacccaggtgagtgcaggggcatgatcatggtgcactgcaggcttaacctcctgggctccagcaatcctcctacctcagcctccaaagtagctgggaccacaggcatgcaccaccactcgtggctaattttttattttttaaagagacagggtctcactatgttgcctaggctggtcttgaactgctggacgcaaaccatcctcccaccccagcctcccaaagtgctgcgattacaggtgtgagccattgcaaccaattgtaaacttttaaatttcataattttttctagaatagtatgagactgaataatattttatttgcatataattaaaatgtgctggagctttagttttcaattcagtttgaattatgtcattaataatggattgagattattgaaacttaaatatttccccaacatacttcaaaatatcctagaaagcctattggcaaatatttttcttatttcttgagtaaacagtggattttaaaaatgtcaaattgtttgacttcttttgattccacatatgagatcacgtagtatttgtatttctgtgtctgcttatttcacttagcataatgtcctctaggtttatagaacagagaatagattagtagtatccagaagctgggaggtggaaagtgggctgggaagttgggagtggaagggggtttcagtcaaagagtgtaatgtttcagttataaaatgagtatattctggaaatctaatctacagcatgttgatgatagttaataataatgtattgtatacctgaaacttgctagaaagtaaatcttcttactggatataaaagataactgtgagatgatggatatattcattagattgataatggtaatcatttagtgaaatattcagatatcaaaacacattgtactccttaaatacaggcaatttcaaaaaatgcaaaagtgctcaaagaacaatggaagcagtcttcattatctatgtttctaaaatgaagatcacaaattcagtcatgtctatacaagatcatatttaaagaaaaataattgtgttgattatatatatctatattctctgatagcttatgatggtcaaacaactaggtgaaaattaaaaagtctggtcaactatcacttagaaggatgtttgtttctaatagtgccaaatattgggatgtttcaagaccgcttaaagcttgacattcaaaagaaacaagaccatgactttcctcacccccaacacacaccacccccacacacacagacacacacacacacatagacacacagattcacacacagacacacaccacacacacacagacacacagatacacacacacagacacacacaccacacacacacacacacacacacagacacatgcacacacccaccccaaagccttttaactgaataacatattcattcaggtgctttggtgtcaccaaagacacagaacttttttttctaaacaagtatatcatatgcagttgtctactctatcatccttatattttaagattttttttcaaaaatgacaacttgatagcttgcatgctctcaaaagaagagaactgtcttttcacggagtgaattgagcacaaatgaagtatttgacaagaaattgtggtttaattattacgcttgcctacctgtgggtacaaggtaggtgtggattttattatatgatctcttttggctgatgggaaagaagaaaccagccagagtactttagttacaactaaggtgcaagcacaaaatgaaaagggaagtgggggcagaacacaaaaacctctttcatgtggaaactggtcatgttcacaaggtacacaaggtaccctggggagaaagtgaaaaacaacacaattatatgctgaaacagtaagaattacaggttaatttcatcatccacaaaatgtgcacaataatattcattatgcaagaaatataaaagagattaaggatagggaaaattcattgtaatttaatataatcatatcattttatgattacagtggatatatttactacagaaaatttgtaagatacataaaaatataataaataaaaatcatgaaatgtcacctggcaaatgatacttaatgcacattttaatgcatttatgttcatatatatattcattcactcaacaaatatttattgtgtgcctactatatttcaaggggacatgcaaatgagcaaaaaaaaaaaaaaagaactcagaaagataaaactccttcctcatagaaaacacattttatcggaaatagggatggtacagggtagtgagcaggggatagaaaaaaacaagtggtaaaaaataagcataatacatatgtgtatcatgcagtatattaggtgatattataaatgatgagtcctatgggggaagaaaagccacatagtgaaatctgctgtggccaatttacctacagccaaggcacaaaggagagtatcagtttctgtaagaattgttcacagaagatccttcaagtccaaactaagaaaaaaacattatttacatttattgccaggcccatcccaaacattcgtggacctcaggtaaaagtaacatggagactttatatactctatgtctaaattcaaaaagtataaatcgagctgaaaaaattataatggaatatgtcctatctcccccctttgacaaatacaaaacctggaaggctaggtgtgactttggaattcatgaactctttgaaattctgtctcaaaacagagtagagacaggcaagcaggccaggccttgatttactacttgtcctcttctcactccaccccattctctcttgtattgtgagggacttcagaagcaagcatgtggacacccaagccctcctgtacatgctttaccatacttccacccccgcttctgcaaacagccaccctgtggccatggctcaggcctccatgcgctcatacagttatcccacccatcctgagagaagaggcccaggtagactctggaacatcagaatcacctgacacatatcccttggggctaaagcctcataaaaatcaccaaaggagtctgagggagaggtcacgaaagatctgcattagggaaaatctgtgagggattgcaaatacaaatgaagcatttttttccccttaaacaacacttctgatcttaaatgtatggggagttgatatggtttgtctgtgttcccatacaaatctcatctgacttataactcccacaattcccacgtgggaaggtggttgaattacgggggcaggtattttctgtgctgttcttgtgatagtgataatgaatctcataagatctgatggttttaaaaatgttttcctgcagaagttctctctttgctgtcatccacgtaagacgtgactttgctcctccttgccttcctctataattgtgaggtctccccagcaatgtggaactataaatccattatctctttttcttcccagtctcaggtatgtctttgttagcagcatgaaaatgaactaatgcagtaaattggtaccagtagagtagggcactgctgaaaagttacctgaaaatatggaagtcactttggaactgggtaacaggcagaggttggaagagtttggagggctcagaagtagataggaaaatgtgggaaagtttggaacttcctagagacttgttgaatgactttgacaaaaatgctgataatgatatgagcaataaagtctaggctgaggtggtttctgatggagatgaggaacttgttgggaaatggaggaaaggtgactcttgttatggtttagcaaggagtctggtggcatgttgtccctgacctaaagatttgtgaaactttgaacttgagatagatgatttagggtaactggtggaagaaatttctaagcagcaaagcattcaagaggtgacttgggtgatgttaaaggcattcagttttataagggaagcagagcataaaagttcaaaaatttgcagcctgacaatgcaatagagaagaaaatcccattttctgcggagaaattcaagctggctacagaaatttgcaaaagtaataaggagctgattgttaatccccaagacaatggggaaaatgtctcccgggcatgtcagaggtcttcagggcagccgctcccagcacagatcagagccctaggagggaaaaacggttttgtgggccgagcccagggtccccgagctgtgtgcagtctagggacttggtgccctgtgtcccagccactccagccatgactaaaaggggccaaggtacagcttgggtcgtggcttcagagggtgcaaactcccaaccttggcagcttccacatggtgttgagcctgcaggtatacacaagtcaagaattgaggtttgggaacttccacctagatttcagaggatgtatggaaccgcctggatgttcaggcagaactctgatgcaggggcggggctctcatggagaaactctgctagggcagtgtggaagggaaatgtggggtctgagaccccacacagtatccctactggggcactgcctagtagagctgggagaagagggccaatgtcctccagacctaataatggtagatcaacctacagcatgcacggtgtgcctggaaaaactgccgactctcaatgccagcccatgaaaacagcagggagagaggctgtaccctgcaaagccacaggggcagagctgcccaagaccatgggaacccacctcttgcgtcagcgtgacccagatgcgagacatggagtcaaaggagataattttggagctttaagatttgactgccctgctggatctcagacttgcatggacttagtagcccctttgttttggcaaatttctcccatttggaacacctgcatttacccattgcttgtacccccattgtatctaggaggtaattaacttgcttttgattttataggctcataggcggaagggacttgccttgtctcagatgagacattggactctggacttttgagttaatgctgaaatgatttagaactttgagggactgttgggaaggcatgaccggttttgaaatttgaggacatgagatttgggaagggctggggtggaatgatatggtttggctgtgccaccactcaaatctcatctttaattgtagctcccacaattcctacatgtcatgggaggaacccggtgggaggtgactgaattatgagggcaggtctttcctgcactgttcttgtgatagtgaatgagtctcacaagatctgatggttttaaagtgggagttttcctccacaaactctctctttgcctgctgccatccgtgtaaaatgtgacttgcccctttttgccttccatcatgattgtgaggcctccccagtcatgtggaactgtaagtccattaaccctctttttcttcctggtcttgggtatgtctttatcggcagcatgaaaacgaactaatacagtggttttccataccaagcaattcaattcttcaagaccaactgggtgtccaagcatccaactctcatactaactacccagtgtttgcaaagaccccacagttttaagtttagtcccacaatgctgcttccatttcagttgccagccacaaatggggtacctagactacccacttttccacccagctgactataaattcaggtgtttccatgaccaaccccttcctcatgcgttggtaattccttagaatgacttgaagaactcaggaaatcactttacttactgttatcagtttattatgaagaatacaactcttctatttctatgccaaatggaagatatgcataggagaaggtatgaagggagtgtgtgtacagagcttccatgccctcccagaaccttaaagtcttaactgatctggaagtactccaaaccccatcatttagggggctttatggaggttccattagtagccataattgattaaaatcactggccattggtaattgaactcaatctccagcccttctcctcaagggattgtgggggtgagggggggatgaaagttctaaccctctaaaaatggctgggtctttctggtgaccacgccccatcttgaatatctaggtttccccagtcaccagtcatctcattagcatacaaaaaatactcagcactttggagcttccaaaggttttaggagttactgctaaataaataatttttttctttctttttttttaactataccacaggaaactctctaaaaagagcagtatgagtactatgagaaatgagccaattctaatcttccctacatgcagaaggcactgtcacagatggtgagcacacagccacataaggctatgacccttctctactcatcccctctttgtgtggttgtaccttgaggaatcagaagctcagctgctgagcacaaaacaagataatcaaagatggtggaagaagtcaattggatgtctcctccctaatggggtttccagatctgaagcagtgtcaagctgatagaaggtaagtagccctatatgtgttattagatcagagttttgatcattacactgatggctggacattttaattactcaaaggagacagttcttaaaactaaggaggaggaaaaggccatggtacaaagctaaattttcatccaggggcagggaaaggaacagcccttagagcaaatagaacaaaacaatcggggaaagaacaaaatggctttgttggcatttcacgttccctacgtcaataaaaatttacatgaccattaggtagttgaacttgtttctttactgggatattatacatcacgacacgtgggggcccaagatttatttgtgctctattgtttctaatagttgatccattaagaaacttgattgtataatgttttacttatttacaaaataaaaatttgaggaataattttagaacaacatagttttgttaggtgtcttctttacaagtacagacaaaattctctctgggatgtatactatcctgagagctttcctataagagcatatcctttgttatatatctaatttgcataaagaatattcttggcactgagttccacataatacttcccttcagtggcatggtcattagaaagtttgaattatagttcatggccttgggccatggcccacttcttagattgatcatgagttgagcagattccaagagttaactgcaggaacaattcaaaccttggtgtcatttggttctgtctcctacgctttagttgattgatctttccaccttcccatttagaaaagaggtttttgaaagaggaaaacatgagcagttatcacaggatttttgaagttcattttgaatatcccacctttagttcttggggaaccttgtcagctctttcttatttgctgttttcagctacttaatcactttttccctgatgagtcactcttcaaaaatggcagctctccatgattgactgggactgttggaaaataggccaccttgctttcaagtatcttttataacatttttttcaggaatttaggctttgcttgcagaaaattaaaattcattctattaagtatgtcttcttcctctgacagctcatcaattagtgactctaagttcttggacaggtttaatcaacccttccatgaagaggcagtttttagtttggagttgacctctgaagcccagctccttctgtttttctgtttttccacgttctacttctctgtcttctgggttcctgtttgagaacatctctatttccatatattcttcgggaattttcatgagatgattatccctaatcacgtaatcaaatagtgtctttctcatctccccctgcacttctcttgtcctctacctaagggaaggtccttataattggcttcattctttctctctctttcttatgcatttacaaatcttcaaactacataatatttgtcttgctctaaccaagtaaaatataggaaaaacgtttgcttgcttagaaagaaagactttaagattagcatagattcaagttaggtctcaagtgggattaaagtatatctggccatcttcaagtgaacaaaattataaactccagggggatagaaatttcatttgttttgttcatcaataatttatctccagaatctattagagtatttggggcatagtattcatccaatagttatatgtagaataaatgactgcaagaataaaaattggaaatatggaaagaagcaaagtagctaagaaggaaagaaaattctatttttggcttaaaaaatatttacatttatgtctggtgggaaatcaggatagaaaggcagcattgagcatggtattagaaccagatattaatacccaacccagcaccacggacacatgtccaaggtggatgaagagaggagctcaggtagagataaaaagctgttcttctgagtaactttgtggtacacagaaagatatgaggccaggcaatagactgagactctatctctaaaaaacatacatgatgtttggttttctttaatgccaagttggcaaagtggagcaaagagattttctcatttccagaagagacatacatgtcttcagcacagtgactatcagaaatacaatcttgcattagttcctggaaagtttgtgaccttggagagaatggaaaaacatacccttgacttgtgcatcagttgggtcaggctagtgccagagtcgaagagatatgagactattagtatcttatatgaaacacctcttgggactcccaggaaaaaaaactgggtttgaatttttaaaagacaaactagaattcttattgtttgtgggaaaaaataagagtcagtaaaatttgccttattacattaatgtagcattattattatcattaataaattaatacagtagttttttttttttttgagacagggtctcactctgtcacccatgctggagtgcagtggcatgatgatggctcgctgcagcctttacctctagtgatcctcccacctcagccccctaagtagctgagactgtaggtgtgcaccaacacgcctggccaatttttgtattttttgtagagacagggtttcaccatattgctcaggctagtctcaaactcctggactcaagcaatccactcacctcagcctcctaaaatgttgggattacaggcatgagccatcgcacccagcaattcagtagttatttctgaatggctaccatgacccaggcactatgataggtgctgcaaatagaatgtcagcagaacacagtttccatctcaaaggatcttccagccagcagggcctaggcataagaaaacaggccctattataactaggtgtgatatgcatgatgatgtgatacatgctgactgcagagtattggggtagcccataagtgagccacatgcttgagaagcttttggaaaatccagttatgcaaagtttggaaataagacccagaaatcaagagttcagatgaaggccaagcttctggccattgagcccatggtctaaagttttcttttttgaacatgaagtaattccacagtcatgattaattccttaaatgcattttgtgacctaaacttttataaggaatctcttctttattaaactcctcttccaatcaatttcccaactggaagcacacctgctgcaataaattgaatatagcactgacttctcttttctcccaaatagttcacttcttatgtcatgagctagaatggtaggggatgaattattaagcaaataccaactataattaaccttgacctgatgcaaatatatacgtgtgtgtgtgtgtatatatatatatatatatatatatatgtttgtaaatgtatttgtaatgtaaacatatatatatatatgtttgtaaatgtattgcatagagttgactagcaaggtcaaacaattcaagtcttttgagctaaaatgtggctgtgatcaaaacagagacacctctcacccctggcagtgctgaaatcagagtaaaaacactgcaaatgcaatcctctcagtatcaaagagcacattcattattcttgttgagcacatgacatacgtcaaacagggtgagttaaatatttttacaagtcactcatcaaataatgagattgttaagacatccaggcaatgcacaaaaggagcatggttttctttttaataattgatttgttcaatcatgaataccccgaacaacagcagagaaaaaaagtgagaactccggtgcagagaaaataattaaaagaagtccaatattgttaggtgttcagagaaacacttaatgaagggaaggaaagcagcttcacacaatttatacataatggcattatttcagattaaatgattactgtaaagtaatgatgtctagtgaaatgtggggaatgtagatcctccatgaggtttataaagaaactaccaaactatttattttaccatttaatatcccacaggacattgctgaattactatggggtatagctaattaagttcagaagaaaacagactcaggatcaaaggtgctacttaaattcacctaagtcaaggttatccattctgtcatttcaactgagccttaatgtaaacagtgactcatgcctagagtctaagtcaaagtgtctagagtcaaaatgtctaatgaatacccaataaaaatgcttcatattaggctagatattggtattaaataaaagggttaaaagaaatttaaaacctattcttatgtactaagaggcatctccaaatacctttattcattcatgtccaatacaatatgtattactgtgtattatacagtccttactatatgccaggtgatctcctaagcaccaggaatacacaaatataaaaaattacatagtattcctcttcctgaaggagctgactctactttatagtagagagatgagtgtatgatgacataaacacaaatggtaagtgttgcaacagaaaggcaaaagtccagagaagcttattcaggctctgtgctaggaagaactaggtaaggcgtcatagagaaagtgatccttgaacttcattcaccttggaaagcagagaatctggggagagattctctttccaggaacagaaaggaggctgagcaaagatgctgtgaggagtagaaatttgtaggcaactgatccagttcccttagaaagaaagaatagtgtattgtctaagagcagaggctcaggaggtggacatgccagtcttaaatcccagcattctcactatctgtgcaacctcagttacctcatctaatctctctgtgcctcagttccctggaaaatggggacagaagtagtaaattggtaacagagtggttctgaggattgaaggagttgatgtagttgtgctgaggtacagagtaagagctgtataagggttgattcttattgtctatcattgggagtagaataatttctttttgcagcctttcctgccaattttctaatttcttagattagtatgggaatctaagtttagggaatgtcacagtgcatttattacaaactgagccaaatgatttgaagaatcattattagggataaagtgattatgaaatacagaagatacctgtgaattttaagaggatgttatccaatgtaaagtgggtaaatcaaagaaaatgtggttgatcttactgaatctatcattttttgtcaaatatctacaaagacttctacagtatgttaagagtctcaaacacataggtagtcaagactagaaagactctttcttcttcccttagcaaagtggggtatatacattttccccagtgttttctaggattggatgaatggatatctcaagtgtccaaagctgagatgtaaatgccaacaaattcacatgctgctatgtgtgactgagtgttcattactagctttgttgataagcacagtgcctgatttatgtgataatcaggatgacagtttccccttccaaaccagttttcaaggatcatattggttgttacagctcccatccctccagggagtggggagcatgtactcactgacctcactgcagcacgatggctgctatgggcaagcttgtgaggaggcttcagctcaatgtgcacatccagggtttacttaccccaacgtatgtgtcctttccatgttgctactcacagaacacttgaccaaccaaacgaattacaagaactagccaacctcttgtactcggaaaggaaatgttattcttgatctattctctaaaatacacagatgattaattaaaattctcttagagttgcaacatcaaatattggagaagccagacaagcaacaaaaatatacaaaaaggtgagtattaaacttaagtgctaacctgcttacaacggaacatttgcccagttcaattgtgcttgaaaatactgtgcagatcaaaccaagtgctcaaacaaagaaatacatctggattttaggccacctattttcaattcttgtaaagcttcacaccttcattttgttttcttctcaatagttttagtcaatgatctcttgcttgattctcctcctaactgtctacttgcctcccctaaagggacatgggaagccaattgtatgccttgggaaggagtgggatgattgtgaccctgaatccctacagagaaagagagtaacaggtaggagggaatgcaatgaactagagtttgtaggaacccctactagctatgtaccttgcaagtcacttgatcttacttcatcctcgatttcctaatctgtaaaatgggaataatattatggtccctgattctcacaaaggatttctgcaagagtaataaaaagtaatgcgaacattttaattattatgatgatgcccaaaggcaaagaggaagaggctctatttactgcataaacagccacagctgcaactcttaagacagaggtaggtttaaaacaatttttttttacatcacag

SEQ ID NO: 836 - DNA, 3150 bp, Homo sapiens
aatcaagaccaaggttaaggtattttgttcccaacatgattcaggatgaggcaaaacaagagaggcacaaaaatgaaacccaatgcttctgttttccagaggccacaaatctaatatcacaatatcattgataaagttatgctttatattcctgtagagagatctaaaatgagtatttacatgttaaactacagcttcacactgacctctgttatgatctcagagaatgttctaaagtcccaaactgaataaaatgtacacctaagaatcccaacaatattcttttttttaagaaatgttgtcttgagagttgactgaacccgggaggcggaggttgccatgagctaacatcaggccactgcactccagcctgggtgaccgagcgagactctgtctcaaaaacaaaaaaaaagtgttgtcccaggccaggcatggtggctcacatgccacctgtaatcccagcactttgggaggcgaaggcaggacgatcaattgagctcagaagttcgagaccagcctgggcaacatggcgaaacccattctctacaaaaaaaacacaaaaattagctgggcatggcggcgcagtgcctctggtcccagctactcagaaggctgaggtaaagggattgcttgagcccgagagatggaggctgcagtgagccatgatcacgtcacagccctgcagcctaggtaacatggtaaaaccctgtctcaaaaaaaaaaaaaaaaaaaaaaaaaaagggtggtctctatcatattcttggataggaagactcagcatcttaagatgtcaatttttttccgaattgacatgaatttaacatgttgccctccaaaaacaaaagcaaacgaacaaaaaaataggaaggcatattttaagtgggagaggaactaaacaaggcatttgaactagacaagttgatcctaaagaattttcctaaccaggaatattctgactgacgggccactagcactaccagatattaaaacacagtagaaggtcttaatagatagtatagtgttgggaggccgaggcgggtggatcacctgaggtcaggagttcgagaccagcctaactaacatggtgaaaccccgtctctactaaaaatacaaaaattaactgggcgtgctgatgggtgcctgtagtcccagctactcgggaggctgaggcaggagaattgcttgaaaccgggaggcggaggttacagtgagccgagattgcgccattgcactccagcctgggcgacaatagtgagactctgtctcaaaagatagatagatagatagatagatagatagatagacagacagacagacagacagacagacagacagatagatagatagtatatgtggtctgggagggacattaatcatagaagtcaaattatttctacaaaaacagtttcaaatacatgatccagcatacagtcaaagataaccaggtgcatgaatacaacatgagtgagagccagaagaaatacaggaaacaaaattaaactcacagagaataccatagagtgaaattattagacagcctataaacaactacgcttattatacaaaatggagttttcttcaaagggctagcaggccgacaactgccttcttaagcaccaacaacggaagccaaaagagtagaacgagagcatcagtgtgccgggaaacaaaccatgaacttagaattctattctcattttttttttttttttgagacggagtctggctctgtcgcccaggctggagtgcagtggtgcgatctcagttcactgcaatctccgcctcccgggttcacaccattctcctgcctcagcctcccgagtagctgggactacaggcgcccaccaccacacccggctaattttttgtatttttagtaaagatggggttttaccgtgttagccaggacggtctctatctcctgacctggtgatccgcccgccttggcctcccaaagtgctgggattacaggcgtgagtcaccacgcccggctctattctcatttttttttttgagatggagtctcgctctgtcgcccaggttggagtgcagtgccgcaatctcggctcactgcaacctctgcctcccggtttcaagcaattctcctgcctcagcctcccaagtagctgggattacagattggctgtgaccacgcctggctaatttttgtatttttagtagagatagggtttcaccatgttggccaggctggtctcgaactcctgtcctcaagtgatccacccgccttggcctcccaaagtgctgggattacaggcatgagccactatgtccggccaaaaatattttttgaaaataaacataaactaatgagtgagagagtctgtcacaaatagactgccactaaaggatattctaaagcagcggtccccaacctttttggcaccagggaccggtttcatggaagacaatttttccatggtggataggggtgagaatggtgaagggagaagtgatggtttggggatgattcaagcacattacatttattgtgcactttatttctattattacattgcagtacataatgaaataattatacaactcaccacaatgtagaatcagtgggagccctgagcttgttttcttgcaactagatggtcccatctgggggtgatgggagacagtgacagatcatcaggcattagattctcatatgaagcctgcaacctagacccctttatgtgcagttcataataggctttacgcgcctatgagaatctaatgctgccactgatctgcgaggaatcagaactcaggcagtaatgtaagcgatggggaacgactgtaaatacagatgaagctgtgctggctcacccgctgctcatctcctgctgtgctgttcaactcctgcctggaacccctgatctaaagggcgttcctgaagcagaaggaaaatggaccaagatggaaagttggagaacacagcatagaatgaagagcaataaaaatgataaatttaaataaatactgcataaaataatcatgataatgttttaaggggttttaataagaacaaagaaatatctaataaatttcaaatatgtatataaagagaattaaaatacatgactagcatatgagtcagaaagtgggtaaatgctaaagttatattttttaaaagacagactt

SEQ ID NO: 837 - DNA, 6695 bp, Homo sapiens
aatcaagaccaaggttaaggtattttgttcccaacatgattcaggatgaggcaaaacaagagaggcacaaaaatgaaacccaatgcttctgttttccagaggccacaaatctaatatcacaatatcattgataaagttatgctttatattcctgtagagagatctaaaatgagtatttacatgttaaactacagcttcacactgacctctgttatgatctcagagaatgttctaaagtcccaaactgaataaaatgtacacctaagaatcccaacaatattcttttttttaagaaatgttgtcttgagagttgactgaacccgggaggcggaggttgccatgagctaacatcaggccactgcactccagcctgggtgaccgagcgagactctgtctcaaaaacaaaaaaaaagtgttgtcccaggccaggcatggtggctcacatgccacctgtaatcccagcactttgggaggcgaaggcaggacgatcaattgagctcagaagttcgagaccagcctgggcaacatggcgaaacccattctctacaaaaaaaacacaaaaattagctgggcatggcggcgcagtgcctctggtcccagctactcagaaggctgaggtaaagggattgcttgagcccgagagatggaggctgcagtgagccatgatcacgtcacagccctgcagcctaggtaacatggtaaaaccctgtctcaaaaaaaaaaaaaaaaaaaaaaaaaaagggtggtctctatcatattcttggataggaagactcagcatcttaagatgtcaatttttttccgaattgacatgaatttaacatgttgccctccaaaaacaaaagcaaacgaacaaaaaaataggaaggcatattttaagtgggagaggaactaaacaaggcatttgaactagacaagttgatcctaaagaattttcctaaccaggaatattctgactgacgggccactagcactaccagatattaaaacacagtagaaggtcttaatagatagtatagtgttgggaggccgaggcgggtggatcacctgaggtcaggagttcgagaccagcctaactaacatggtgaaaccccgtctctactaaaaatacaaaaattaactgggcgtgctgatgggtgcctgtagtcccagctactcgggaggctgaggcaggagaattgcttgaaaccgggaggcggaggttacagtgagccgagattgcgccattgcactccagcctgggcgacaatagtgagactctgtctcaaaagatagatagatagatagatagatagatagatagacagacagacagacagacagacagacagacagatagatagatagtatatgtggtctgggagggacattaatcatagaagtcaaattatttctacaaaaacagtttcaaatacatgatccagcatacagtcaaagataaccaggtgcatgaatacaacatgagtgagagccagaagaaatacaggaaacaaaattaaactcacagagaataccatagagtgaaattattagacagcctataaacaactacgcttattatacaaaatggagttttcttcaaagggctagcaggccgacaactgccttcttaagcaccaacaacggaagccaaaagagtagaacgagagcatcagtgtgccgggaaacaaaccatgaacttagaattctattctcattttttttttttttttgagacggagtctggctctgtcgcccaggctggagtgcagtggtgcgatctcagttcactgcaatctccgcctcccgggttcacaccattctcctgcctcagcctcccgagtagctgggactacaggcgcccaccaccacacccggctaattttttgtatttttagtaaagatggggttttaccgtgttagccaggacggtctctatctcctgacctggtgatccgcccgccttggcctcccaaagtgctgggattacaggcgtgagtcaccacgcccggctctattctcatttttttttttgagatggagtctcgctctgtcgcccaggttggagtgcagtgccgcaatctcggctcactgcaacctctgcctcccggtttcaagcaattctcctgcctcagcctcccaagtagctgggattacagattggctgtgaccacgcctggctaatttttgtatttttagtagagatagggtttcaccatgttggccaggctggtctcgaactcctgtcctcaagtgatccacccgccttggcctcccaaagtgctgggattacaggcatgagccactatgtccggccaaaaatattttttgaaaataaacataaactaatgagtgagagagtctgtcacaaatagactgccactaaaggatattctaaagcagcggtccccaacctttttggcaccagggaccggtttcatggaagacaatttttccatggtggataggggtgagaatggtgaagggagaagtgatggtttggggatgattcaagcacattacatttattgtgcactttatttctattattacattgcagtacataatgaaataattatacaactcaccacaatgtagaatcagtgggagccctgagcttgttttcttgcaactagatggtcccatctgggggtgatgggagacagtgacagatcatcaggcattagattctcatatgaagcctgcaacctagacccctttatgtgcagttcataataggctttacgcgcctatgagaatctaatgctgccactgatctgcgaggaatcagaactcaggcagtaatgtaagcgatggggaacgactgtaaatacagatgaagctgtgctggctcacccgctgctcatctcctgctgtgctgttcaactcctgcctggaacccctgatctaaagggcgttcctgaagcagaaggaaaatggaccaagatggaaagttggagaacacagcatagaatgaagagcaataaaaatgataaatttaaataaatactgcataaaataatcatgataatgttttaaggggttttaataagaacaaagaaatatctaataaatttcaaatatgtatataaagagaattaaaatacatgactagcatatgagtcagaaagtgggtaaatgctaaagttatattttttaaaagacagacttccaaactaacagaggaaacagtggaatgatacaacacagacacctacatacgaaaataaaatactgacggctgggcgcggtggctcacgcctgtattcccagcactttgggaggcaaaggcaggtggatcacctgaggtcaggagttccagaccagcctggccaacaaggtgaaatcccgtctctactaaaaatacaacaattaacagggcgtggtggtacatgcctgtaatcccaactacttgggaggttgaggcaggagaatcatttgaacctgggaggcagaggttgcagtgagccgagattgcatcactgcactccagcctgagtgagagagtgagactccatctcaaaagaaaaagaaaagaaaagaaaagaaaatactgacacataagtagtcaaaacaatggaatgggatagaaaatccagatatatgttcaagtatatatgggaatttagtaaatgataaaagaggtgtatcataccagtagagacaggaactactgaataagtggtgttgggacaactagatattcatctagaaaaaaataagttgtatctataccttgtaactcataccaggataagtcctgagtaaatcaaatattgaaatgtgaaaaattaaaccacaaaggttctacaagaaaacataggagaatcttttataatctgaaatgagacctttctattctgactcatgatccaaaaatcacaataaaagattgacaattcaactacataaaattttttttaaaaaatacaaaccaggtgggaggagggtgcgggataaaagactacactttggatacagtgggcactgctcgggtgatgggtgtacccaaatctgagaaatcaccactaaagaacttatctggctggacacggtggctcacgcctgtaatcctagtactttgggaggctgaggcaggcggtcacttgaggtcaggagttagagaacagcctggccaatatggtgaaaccccatctctactaaaaatacaaaaaaaaattagccaggcgtggtggtccatgcctgtaatcccagctacttaggaagctgaggcaggagaattgcttgaactcgggaggcggaggttgcactgagccgagattgtaccactgtactccagcctgggcaacagagcgagactccatctcaaaaagaaaaaaaaaaagaatttatccatgcaactaaacaccacctgttcctcaaaaactactggaaaaaaaaaaaaaaacccaccaggtgtggctcaccctgtaatcccagcactttgggaggccgaggcgggtggataacctgaggtcaggggttcgaaaccagccttgaccaacctggtgaaaccccctctctactaaaatacaaaaattagctggacctcgtggcatccgcctgtaatccttgccactagggagactgaggtaggagaattgcttgaagccaggaggcggaggttgcgccactgcactccagcctgggtgacagagcgagactccatctcaaaaaaaaaaaggcaatgtggaagctctcaatgtactgttattgagaaatcttcaagatatattgttaagtgaagaaaaacaagctgcacctaacattctactttttgtggaaaaggagaggaatagaagctctaagtgtatttacttgcatagcattaaaaaattccctaaagacagattagaaactaagaacagttggtacccacatgtagtttatttgaacaaaacaacaacttaataatgaaagtgggccggctgtggtggcttatgcctgtaatcccagcactttgggagaccgagatgggaggatcacttaagaccagcctggtcaacatagtgagaccttatctctattttttaaatttaaataataaaaattttaaaaaataataataatgaaaaagtcttcaacattatgcattcttcaattttcctgtgagcctccttgtttattcatttgaaagtacaatatattaaaattcaccacaaaattgcagaagtgggccggatgcggtaactcacacctggaatcacaacactttgggaggccgaggcgggcggattacttgaggccaggagttcaagactagcctggccaaaatggtgaaaccctgtctgctaaaaatacaaaaattagctgctgggtgtggtggtaggtgcctgtaatcccagctaattgggaggctgagacagaagaattgcttgaacccaggaggcagaggttgcaatgagccgacattgcgccattatactccagactaggtgacagagcaagacttcatctcaaaaaaaaaaaaaaaaaaaaaattgtagaagtgttttctatccctagttgagaactgaagaagagaaatctaaccagagaatttggtaagcacatcttatatgcattttttaaagacattaattccagttatccctggtactgggactgcaggtgattttaattatctcctttgtgttctgtgtttctccagggccactgttaattttataattagcttaaaatttgttcaaataaagtaaatattataaagagaaattgtcttcagtagttaagaaaaggatgaaattttgagtttgagggtaactaggctgggcatagtggattatgcctgtaatcccagcactttgagaggctgaggctggtggatcacttgaggtcaagagttcgagaccagcctggccaacatggtgaaaccccatctctacaaaaaatacaaaaattagctgggcatggtagcatgtgcctgtagtcccagctactcaggataattgcctgaacccgggaggcagaggttggtgtaagcctagatcatgccactaaactccagcctggggaagagacagagcaaggctctgtctaaaaaaagaaaagcaagaaagaaagagagagagagagaaagaaagaaagaaagagagagagagagaaagaaagaaaaagaaagaaagaaagaaagaaagaaagagaaagaaagaaagaaaaataaactttgactttgagggtaatgaaaaattggaacagtttcctaagaaagataatcataatttccatttctgtaaaactttataaaattgtattagacatctttggtttaaattttcatttgttaaaggctatggtggatcagatgaccttttgccacaaagctttcatagcaaccgaagagcagtgtttagaatatttttcacttaaataatgaggaagaacagggctgactgcacgaggtggaagaatccagattgtgcaaatggtcttccgttctgcagcctctctgcagttgttgtgggttattagacttccgagatctaaatattctcccagagtgtaggaaactcctcctaaagttttacataaaatataatctcattatttcagaaatagactgggtaaaactagtaccatgagaagaaacaagcttttcagttaagaccgagtttaattctggtttttctaagaaataaagacttttatttgtttgattccagagaacctcaggggacacccgactgagacaaactgaaaagttagaagaaagaatt

SEQ ID NO: 838 - DNA, 12761 bp, Homo sapiens
aaataagaatgaaaggatgccagagtaggatatccctagcaatatgtttttccactgcatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaagggaaggaaggggataaagggtgaaaaactacctattgtgtactatgctcactacctgggtgatgggatcattcgtaccccgaacctcaccatcacacaatatacccatgcaacaaatctgcacacgtacccctgaacctaaaataaaagttgaagttaaaaaagaaaaaaatagtacttttgaaataaaaagcaagaagaaaaatacttcactgacactataaaattaagagggaaacctataaacagttcacttgaggtgtaaaagtataacagtcatttaattaatgggcttatttcttttatgggcattcgtttgattaaatcttttgttcaggcatatttataattttatattatactgtcactctggtcttctacattgcctcatttactgtacttcttttgtttgtgttgtatcttcttttcagtttagttgtagttgttagggtccacccaactggacagtttccccctcctatagacctaagccccaaaggccaaaagtaaaaccccctaccccaaacctgcctgtatctgtctgaccagaggccagctgttccaggatggggtcaagacgtctaccttacacaacagaactggcaagaaaaacatctccaggaagtggtcagacacctggcacaaaggaccccccacccttttctttttccttcaccctgacccagttctatgccctataaaaccttgctatagcctgtaagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagcaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaacaatttcggtacccagtccttgagataactttctgaaggaatgatgttaacattaatgaataaaaaaggaacaaataaaaagtacaccacacatactttgcttgtgttctggtagcactagccctaaacacaatatgagtaaggtaacaaaaaagtaacctgagatatattaaaaatggttttaaagccaaaagggaggaagaaaggaaaaaaggaaggaagggggaagggcgaaagtgaaaaacatatggaggaaggaaaggaaaataatatcaaatgttcacagagtgcttattctgaattatgtaccctcttatgtgctttatataaattatattgtaaggttgaaaatatgtgctctggagaagagctgcacggaataaaatcccacttctgctttttactgatggtgtgacatttagcggattagttaatttggtcattgcttcagtttcctatttgactgtcctaccataagactataataaaccaatgcatataaaaatgcttagcactgagtctgacatatggtaagcatacaataaattttaactacaattatccaatgaaaacctaacaacaacactatgaagtttgtataattattatttttacttttttgataaggagtctgaatcacaaagggattaaataatttactcaaagtcacgcaggtattaatcatgaatctatcttccagtaaatatcaatagaaaacaagatgtgggatttgagtgcaggcaattagactccagagcctgtttttaaactctatgttattacaagaagacatgcacgtacctttaaaagaagaaaatttgagacagcaaatgcttaacaaccaagaaattacaaaagaaaaaaacctacaatctatgaaacaaaaattatatgatgagattaattaatacatttaacaaatacttattgagcaccaattattggttcaaccatgcttttaggtactgagaattcaactgtgaactggtctctactttcacagaatatactttataatacagtataaaatggcataacaaaatggaaatggggttggtaaaggcagcaaaaatcttcaacagaaaaataaatatttttataaaccaataatttttgaaagataggatatagcatataagcatatggaaaataggtatccatgatagagaatataatagtggaacagttaatgacttctgacatgaaggaagtactgagatgagaattgaacaggatttgttttccttcagaaaaaaaataatcggtagaaaaaatatatgctggtatagctaaaaaaatttgaggattaaaaaatctcttctatacaatatataaaaatgcatagcacctgtaagaaaacaaatatattgggttggattcaaatttttttgtaccaaaatttccaatagataatggagcaagtctgcaaggatatgggcaaaaaatagtgggatctaaatatgttgtacatagattgttattcctgtcaaagggatgaggagttggtctcatatatgtactaacacagcagatacaataattcggaaacttcttgagaagctttgtagttatatatacactgtaattatttataatactattaaatgcaatataacaatttaatacatagagaagctgccttattgaaatattgaaataagcattgaaaaatctaaatgtagctggcaagatggcctaatagaaacagctctggtctgcagctcccagcgagatcaacacagaaggcaggtgatttctggatttccaactgaggtacccagttcatctcattgggactggttagacagtgggtgcagcccacggagggtgagctgaagcagggtggggcatcaccccaccagggaagtgcaaggggtttgggaaatccctctcctagccaagggaagccctgagagattgtgccttaaggaatggtgcattctggcccaaatactacacttttcccatggtctttgcaacctgcagaccaggagattccctcaggtgcctatgccactagggccctgggtttcaagcataaaactggggatcatttgggcagacacccagctagctgcagtttttctttttttcataccccagtggcaccaggagcccgagtgagacagaacccttcaatcccctggagagagggctgaaatcagggagccaagtggtctggctcagtggtcccacccccacggagcccagcaagctaagatccactggcttgaatttctcactgtcagcacagcagtctgaagtagacctgggaggctccagcttagtggggggagggacgtccaccattactgaggcttgagtaggcagttttcctctcccagtgtaaacaaagcctccaggaagttcaaactgggtggcaaagccacagtagccagactacctctctagattcctcctctctgggcagggcatctctgaaagaaaggcagcagcccaaacaggggcttatagataaaatctccctgggacagagcacctgggggaagagcggctgtgggtgcaacttcaacaaacttaaacattcctgcctgctggctctgaaaagagcagcagatctcccagcacagtgctccagctctgctaagggccagactgcctcctcaagtgggtccctgacccctgagtcccctgactgggagacacctcccagcaagggttgacagacacctcaaacaggagagctctggctggcatctggcaggggcccctctgggacaaagcttccagaggaaggaacaggcagtaatctttgctgttctgcagcctctgctggtgatacccaggcaaatagggtctggagtgaacctccagcaaactctagtagacctgcagcagaggggcctgactgttagaaggaaaactaacaaacagaaaggaatagcatcaacatcaacaaaaaggaagtccacaccaaaaccccatccataggtcaccaacatcaaagaccaaaggtagataaatacatgaaaatgaggagaaaccagcacaaaaattccaaaaaccagaatgccttttctcctccaaaggaccacaactccttgccagcaaaggaacaaaactggatggagaatgagtttgacaaattgacagaagtgggcttcagaaggtgggtaataacaaactcttccaagctaaaggagcatgttctaacccaatgcaaggaagctaagaaccttgaaaaaaggttagaggaattgctaactagaataaccagtttagagaagaacataaatgacctgacggagctgaaaaacacagcacgagaacttcatgaaacataaacaactatcaatagccaaatcgatcaagcggaagaaaggatatcagagattgatgatcaacttaatgaaataaagcgtgaagacaagactagagaaaaaagaatgaaaaggaacaaacaaagcctccaagaaatatggtacaatgtgaaaagaccaaacctttgtttgactggtgtacctgaaagtgacagggagaatagaaccaagtgggaaaacacttttcaggatattatccaggagaacttccccaacctagcaagaaaggctgacattcaaattcaggaaatacagagaacaccacaaagatactccctgagaagagaaacaccaagaaacataatcatcagattcactgaggttgaaatgaaggaaaaaatcttaagggcaaccagagagaaaggttgcattacccacaaagggaagccagtcagattaacagccaatctctctgcagaaaccctacaagcaagaagagagtaggggccaatattcaacattcttaaagaaaagaattttcaacccagaatttcatatctagccaaactaagcttcataagtgaaggagaaataaaatcctttacagagaagcaaatgctgagagattttgtcaccaccaggcctgccttacaagagctcctgaaggaagcactaaacatggaaaggaaaaaccggtaccagccactgcaaaaacataccaaattgtaaagaccatcaacgctatgaagaaactgtatcaactaacaggcaaaattaccagctagcatcataatgagaggataaaattcacacatatcaatattaaccttaaatgtaaatgggctaaatgccccaagtaaaagacacacactggcaaatcggataaagagtcaaaatccactggtgtgctgtattcaggagacccatctcacttgcaaagaaacaaataggctcaaaataaagggatggaggaatatttaccaggcaaatgaaaagcaaaaaaaaaagcaggggttgcaatcctagtgtctgataaaacagactttaaactgacaaagatcaaaaaagataaggaaaagcattacataatggtaaagggatcaatgcaaccagaagagctaactaacttaaatttatatgcacccatacaggagcacccagattcataaaacaagttcttagacacctacaaagagacttagactcccacgcaatagtagtgggagactttaacaccccactgtcaatattagacagactgatgagacagaagttaacaaaaatattcaggacttgaactcagctctggaccaagcagacctaacagacatctacagaactctccagcccaaataaagagactatacgttcttctcagcaccacgtcacacttattctaaaattgaccacataattggaagtaaaatactcctcagcaaatgcaaaagaacagaaatcataacaaacagtctctcagaccacagtgcagtcaaattagaactcaggattaagaaactcactcaaaactgcacaactacatagaaaccgaacattctgctcccaaatgactactggttaaaaattgaaattaaggcagaaataagtaagttctttgaaaccaatgagaacaaagacaccatgtaccagaatctctaggacacaattaatagatcttcctgctttctcctgtgtgcatttagtgcccataagagaaagcaggaaagatctaaaattgacaccctaacatcacaattaaaagaactagagaagcaagagcaaacaaattcaaaagctagcagaagacaagaaataactaagatcagagcagagctgaaggagatagagacatgaaaaacgcttgaaaatatcaatgaatccaggagctggtttttttgaaaagattaacaaaatatgtagaccactaggcacattaataaagaagaaaagagagaagaatcaaatagacacaataaaaaattataaaggggatatcatcactgattatcatcactgatcccacagaaatataaactaccatcagaatactataaacacctctgtgcaaataaactagaaaatctagaagaaatggatacattcctggacacatacaccctcccaagactaaaccaggaagaagttgaatccctgaacagaccaataacaagttctgaaactgaggcagtaattaatagcctaacaaccaaaaaaagcccagaaccagatggattcacagccgaattctaccagaggtacaaagaggagctggtaccgttacttctgaaactcttccaaacaatagaaaaagagggactcctccctaactcatggaatgaggccagcatcatcaggataccaaaacctggcagagacacaacaaaaaagaaaatttcaggccaatatctctgatgaacattgatgcaaaaatcctcgataaaatactggcaaaccaaatgaggcagcacatcaaaaagtttaccaccatgatcaagttgacttcatccttgggatgcaaggctggttcaaaatatgtaaatcaatcaacgtaatccatcacataaacagaaccaatcacaaaaaccacatgattatctcaatagatgcagaaaaggcctttgacaaaattcaacagcccttcatgctaaaaactctcaataaactagatattgatggaatgtatcttaaaataataagagctatttatgacaaatccacagcaaatatcatactgaataggcaaaaactggaagcattgcctttgaaaactggcacaagtcagggatgacctctctcaccactcctattcaacatagtgttggaagttctggccaaggcaatcaggcaacagaaagcaataaggtgtattcaattaggaaaggaggaagtcaaattgttcctgtttgcagatgatatgattgtatatttagaaaaccccatcgtctcagcccaaaatctccttaagctgataagcaacttcagcaaagtctcaggataccaaatcaatgtgcaaaaatcacaaacattcctatataccagtaatagaaaaatagagccaaatcatgagtgaactcccattcacaattgctacaaaaagaataaaatacctaggaatacaacttacaaggtatgtgaaggacctcttcaaggagaactacaaaccactgctcaaggaactaagagaggacacaagcaatgcccatggataggaagaatcaatatcatgaaaaatggccttcctgacaaaagtattttatagagtcaatgctatccccatcaagctacgactgactttcttcacagaattagaaaaactactgtaaatttcatatggaaccaaaaaagagcccatatagccaagacaattctaagcaaaaagaacaaagctggaggcatcaggctacctgacttcaaactgtactacaaggctactgtaactgtacagttacagtacggtttggtaccagtaaacagcatggtaccagtaccaaaacagatatatagaccgtggaacagaatagaggcctcagaaataatgccacatatctacaaccatctgatctttgacaaacctgacaaaaacaagaaatggggaaaggattccctacttaataaatggtgctgggaaaactggctagccatatgtagaaggctgaaactggaccccttccttacaccttacacaaaaattaaccaagacggattaaagactaaatgtaagacctaaaaccataaaaaccctagaagaaaacctaggcaataccattcaggacataggcatgggcaaggacttcatgactaaaacaccaaaaacaatggcaataaaagccaaaattgacaaatgagatccaatgaaactaaagagcttctgtgcagcaaaagaaactatcatcagagtgaacaggcaacctacaaaatgggagaaaatttttgcaatctatccatctatccatctgacaaagggctaatatccagaatctacaaggaatttaaacaaatttaccagaaaaaacaaccccatcaaaaagtgggtgaaggatacgaacagacacttctcaaaagaggacatttatgaggctaacaaacatatggaaaaaaagctcatcatcactggtcattagagaaatgcaaatcaaaactacaatgagataccatctcacgccagttagaattgcaatcattaaaaagtcaggaaacaacagatgctggagaacatgtggagaaaagggaatgcttttacactgttgtggaagtttaaattagttcaaccattgtggaaaagaaaacctccaacctctcaactatgtatatagaaagtccaaggaaaagatctcaggtaatactacaaaaattgggaagtataggtggtctattgatttcctattagtgcggtaccaagttgtcacacttagtgtctaaaatagcacacatttgttatcttgtagttctgaaggccagaagtctggaatggtttccactaggctaaaatcaagatattggcaaggctgcgttttttttcttaaggctctacagaagaatctgacttcttgcttttcttttccagctactacacgttgtctgcattccttggctcatggtccttttaatctttaaagccagcaaaggcccatcaagttggtctcacctggaagagctctaatactgatgcttctttgtctcttccacttttaaggactctcacgattacattaagcccacctatataaccaggatatcctattttaatataagctaactagcaaccttaattcccctctgtcatgtaacctaacctattcagaagttctggagatttggacagagacacttgggaagccattatgctgctgaccataggtggtaggaagtttaaattttatagctaaggacaataagcattcattcatttctgaggtagattaatattgaaatattttacatttatggaatttttctaatttagaaattttctaatatttcctcaggataagattatgcatttttgacaaaaatattgctaaactgatgttgaattctcatgcattacatcaaggagcatatgatatacttgcatctcattatccaaaacgttatcttggatcatttaactacggtagaatctgcccagttttttcactgaaaagttacaattttaactttgaaattaataaagtatcttgtgggtagataatttcagactatgtaactatcctgtttcaaatttttgtccactgctttaagcagtcatttataattctttgctggaacacaccaacagtgtggggaggtcaattttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcatcctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcggtggctcacgcctgtaatcccagcactttgggaggctgaggcaggcagatcacgaggtcaggagatccagaccatcctggttaacacagtgaaaccccgtctctactaaaaatacaaaaaaaattcgctgggcgtggtggcgggtgcctgtagtcccagctactcgggagggtgaggcgggagaatggcgtgaacccgggaggtggagcttgcagtgagccgagatcgcgccactgcactccagcctgggtgacagagctagactccatctcaaaaaaaaaaaaaaaaaaaaaaaaaaaagtcatacagattctaaataatttcttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaataatttcttgatacattgtgtaagaacagaattatgctaagtgaaaccaagacaagtaacctagccctatattaagagactcacaatatggtggctgtgtctgcatacagaaatataaaaaaataatattcaggccacgcacggtggctcatgcctgtaatcctagcattttgggaggctaaggtgggtggatcactcgaactcaggagttcaagaccagactgggcaacgtggcaaaactccatctctactagaaatacaaaaattagctggtcatgatggcgtgcacctgtggtctcagctacttggggggtgaggcaggaggatcacttgaacctgagagatcaaggctatagtgagctgagatggtgccactgcactcccatccaggtgacagagtgaaacccctgcaaaacaaattaataatattaaattaattgagtcagagcagaatatggcaaatacaagaagttatttctttaggagtttcaaaaatgtagacctcgtatcttcttcagattatcaggaaagctagaggcatgtgagttagctttaaattaataagtgagtcttgacagaatatgatacctggaggtagagggaaggagagttttggaaggcaagggaaatggatagagtgcatgccaaaagaagtgaaatatagagtgtattagaaataaaatataataataaccattacttatggcacaaattggaattttcaaatgctcttggttaaaatcctaataatttcagtgccttatttataattcagttttatgtaaaacttatagattattatagaaagaccacaaaaattccatggcattttacaagtgttcctcttaaactcaggcacagaatttatgctttactggttcctaattatgtttttcttttctgtctcttctttattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgt

SEQ ID NO: 839 - DNA, 1244 bp, Homo sapiens
tcaagcgattagtatctcagatctcataatttggttgataaaggggtttcaggagagaaaaggatattgaaaaagggctaagcaatcttgcgttgctgtagtgaaacaaaggcaaacataattttgattttttttaagaaaattacatgatgctgagtattggtgcataatttcacgtccagcagtaatcgttaacaagagcagttgtcataggaataccagcagtggtgtggcagaggtggtggtggtaattttagtgcagatagaaagccttaaaggaacaccatctatgtgacagccacagtgccaagtgtgacttgcattatctcttttattttggcaaacagatattaaggtgagggtcaatattatccctgcaaggttaggtttacacaattataaaatttcaaagctgagattcaaactcagttgcgtctcatcccacaatccaagctatttttaaggggggaaataacattcattatgattaatggtagtgtggcaccatatagttcaaaatttgaaattgaaagagtatttagaaatcctgagttttagggttgactctgctatgctataaaattgatgtgtgggaaagatacttctgttccccgagtctgcaaatgagcataccaatgccatttttcttccagatttgttctggtaaacacatgattgcataaaaataatatgaaaaaaagatctactaaaaattgatttaaactgtgtagacattaagagagctcttataaaatgctattcactacattatgaactgggaataaaactaatagttaagacacaaaccttcaaatgtcaaaaaaaaattggggtccatacaactgtacaagaaaaaatctgagtacattatgcatccattcatgtttaatgattgtagtagacatctgtaatttttacccattaagccagcctcctagtaagagacccatctcttccccaatcccagatccctgtgttttggataggatgccttccatcctttgtgtccaaggatagaccctatagctcgagctcagccaacaagacagccataaccacagtaactgatgtagaagaaggtttatggcacaagcctaggtgaaaaaacagagagagagagaaagagagagaaaggatgctacatttgacacattttttccaacttttcttctttattggatgtctcatttatatgagccagcaaattcctgtctattgaaagctaggttgcactggttttctct
